United States Patent
Angel et al.

(10) Patent No.: US 9,770,489 B2
(45) Date of Patent: Sep. 26, 2017

(54) METHODS AND PRODUCTS FOR NUCLEIC ACID PRODUCTION AND DELIVERY

(71) Applicant: Factor Bioscience Inc., Cambridge, MA (US)

(72) Inventors: Matthew Angel, Cambridge, MA (US); Christopher Rohde, Cambridge, MA (US)

(73) Assignee: FACTOR BIOSCIENCE INC., Cambridge, MA (US)

( * ) Notice: Subject to any disclaimer, the term of this patent is extended or adjusted under 35 U.S.C. 154(b) by 0 days.

(21) Appl. No.: 14/761,461

(22) PCT Filed: Jan. 30, 2015

(86) PCT No.: PCT/US2015/013949
§ 371 (c)(1),
(2) Date: Jul. 16, 2015

(87) PCT Pub. No.: WO2015/117021
PCT Pub. Date: Aug. 6, 2015

(65) Prior Publication Data
US 2016/0324934 A1 Nov. 10, 2016

Related U.S. Application Data

(60) Provisional application No. 61/934,397, filed on Jan. 31, 2014, provisional application No. 62/038,608, (Continued)

(51) Int. Cl.
| | |
|---|---|
| *A61K 48/00* | (2006.01) |
| *A61K 31/7105* | (2006.01) |
| *A61K 31/713* | (2006.01) |
| *C12N 15/00* | (2006.01) |
| *C12N 15/90* | (2006.01) |
| *A61K 38/39* | (2006.01) |
| *A61K 38/38* | (2006.01) |
| *C12N 15/87* | (2006.01) |
| *A61K 38/44* | (2006.01) |
| *A61K 38/45* | (2006.01) |
| *A61K 45/06* | (2006.01) |
| *A61K 31/573* | (2006.01) |
| *A61K 31/575* | (2006.01) |
| *A61K 31/7068* | (2006.01) |
| *A61K 31/7072* | (2006.01) |
| *A61K 31/711* | (2006.01) |

(Continued)

(52) U.S. Cl.
CPC .............. *A61K 38/39* (2013.01); *A61B 18/18* (2013.01); *A61K 8/606* (2013.01); *A61K 9/0019* (2013.01); *A61K 9/0021* (2013.01); *A61K 9/127* (2013.01); *A61K 31/573* (2013.01); *A61K 31/575* (2013.01); *A61K 31/7068* (2013.01); *A61K 31/7072* (2013.01); *A61K 31/711* (2013.01); *A61K 31/713* (2013.01); *A61K 31/7105* (2013.01); *A61K 38/38* (2013.01); *A61K 38/44* (2013.01); *A61K 38/45* (2013.01); *A61K 45/06* (2013.01); *A61K 47/46* (2013.01); *A61K 48/00* (2013.01); *A61K 48/005* (2013.01); *A61M 35/00* (2013.01); *A61Q 19/00* (2013.01); *A61Q 19/008* (2013.01); *A61Q 19/06* (2013.01); *A61Q 19/08* (2013.01); *C12N 15/87* (2013.01); *A61B 2018/00452* (2013.01); *A61B 2018/1807* (2013.01); *A61K 2800/83* (2013.01); *A61K 2800/91* (2013.01)

(58) Field of Classification Search
None
See application file for complete search history.

(56) References Cited

U.S. PATENT DOCUMENTS

| | | | |
|---|---|---|---|
| 3,539,465 | A | 11/1970 | Jensen et al. |
| 5,843,780 | A | 12/1998 | Thomson |

(Continued)

FOREIGN PATENT DOCUMENTS

| | | |
|---|---|---|
| CN | 101200758 | 6/2008 |
| EP | 2241572 | 10/2010 |

(Continued)

OTHER PUBLICATIONS

Dang et al., Mutation analysis and characterization of COL7A1 mutations in dystrophic epidermolysis bullosa. Experimental Dermatology, 2008, 17, 553-568.*

(Continued)

*Primary Examiner* — Scott Long
*Assistant Examiner* — Arthur S Leonard
(74) *Attorney, Agent, or Firm* — Morgan, Lewis & Bockius LLP

(57) ABSTRACT

The present invention relates in part to nucleic acids, including nucleic acids encoding proteins, therapeutics and cosmetics comprising nucleic acids, methods for delivering nucleic acids to cells, tissues, organs, and patients, methods for inducing cells to express proteins using nucleic acids, methods, kits and devices for transfecting, gene editing, and reprogramming cells, and cells, organisms, therapeutics, and cosmetics produced using these methods, kits, and devices. Methods and products for altering the DNA sequence of a cell are described, as are methods and products for inducing cells to express proteins using synthetic RNA molecules, including cells present in vivo. Therapeutics comprising nucleic acids encoding gene-editing proteins are also described.

7 Claims, 9 Drawing Sheets

Related U.S. Application Data filed on Aug. 18, 2014, provisional application No. 62/069,667, filed on Oct. 28, 2014.

(51) Int. Cl.

| | |
|---|---|
| *A61K 9/00* | (2006.01) |
| *A61K 9/127* | (2006.01) |
| *A61K 47/46* | (2006.01) |
| *A61B 18/18* | (2006.01) |
| *A61M 35/00* | (2006.01) |
| *A61K 8/60* | (2006.01) |
| *A61Q 19/00* | (2006.01) |
| *A61Q 19/06* | (2006.01) |
| *A61Q 19/08* | (2006.01) |
| *A61B 18/00* | (2006.01) |

(56) References Cited

U.S. PATENT DOCUMENTS

| | | |
|---|---|---|
| 7,276,489 B2 | 10/2007 | Agrawal et al. |
| 7,442,548 B2 | 10/2008 | Thomson et al. |
| 7,449,334 B2 | 11/2008 | Thomson et al. |
| 7,621,606 B2 | 11/2009 | Page et al. |
| 7,682,828 B2 | 3/2010 | Jaenisch et al. |
| 7,687,266 B2 | 3/2010 | Chambers et al. |
| 7,812,000 B2 | 10/2010 | Agrawal et al. |
| 8,048,675 B1 | 11/2011 | Irion |
| 8,048,999 B2 | 11/2011 | Yamanaka et al. |
| 8,058,065 B2 | 11/2011 | Yamanaka et al. |
| 8,071,369 B2 | 12/2011 | Jaenisch et al. |
| 8,129,187 B2 | 3/2012 | Yamanaka et al. |
| 8,202,850 B2 | 6/2012 | Agrawal et al. |
| 8,278,036 B2 | 10/2012 | Kariko et al. |
| 8,420,782 B2 | 4/2013 | Bonas et al. |
| 8,440,431 B2 | 5/2013 | Voytas et al. |
| 8,440,432 B2 | 5/2013 | Voytas et al. |
| 8,450,471 B2 | 5/2013 | Voytas et al. |
| 8,470,973 B2 | 6/2013 | Bonas et al. |
| 8,586,526 B2 | 11/2013 | Gregory et al. |
| 8,691,966 B2 | 4/2014 | Kariko et al. |
| 8,710,200 B2 | 4/2014 | Schrum et al. |
| 8,716,465 B2 | 5/2014 | Rossi et al. |
| 8,748,089 B2 | 6/2014 | Kariko et al. |
| 8,802,438 B2 | 8/2014 | Rossi et al. |
| 8,822,663 B2 | 9/2014 | Schrum et al. |
| 8,835,108 B2 | 9/2014 | Kariko et al. |
| 8,883,506 B2 | 11/2014 | Rossi et al. |
| 2003/0009148 A1 | 1/2003 | Hayakawa |
| 2003/0083272 A1 | 5/2003 | Wiederholt et al. |
| 2003/0228658 A1 | 12/2003 | Shu et al. |
| 2005/0053588 A1 | 3/2005 | Yin |
| 2005/0130144 A1 | 6/2005 | Nakatsuji et al. |
| 2005/0192357 A1 | 9/2005 | Arai et al. |
| 2007/0134796 A1 | 6/2007 | Holmes et al. |
| 2008/0009785 A1 | 1/2008 | Mikszta et al. |
| 2008/0213377 A1 | 9/2008 | Bhatia et al. |
| 2008/0233610 A1 | 9/2008 | Thomson et al. |
| 2008/0260706 A1 | 10/2008 | Rabinovich et al. |
| 2009/0029465 A1 | 1/2009 | Thomson et al. |
| 2009/0093433 A1 | 4/2009 | Woolf et al. |
| 2009/0275128 A1 | 11/2009 | Thomson et al. |
| 2009/0286852 A1 | 11/2009 | Kariko et al. |
| 2010/0003757 A1 | 1/2010 | Mack et al. |
| 2010/0047261 A1 | 2/2010 | Hoerr et al. |
| 2010/0075421 A1 | 3/2010 | Yamanaka et al. |
| 2010/0120079 A1 | 5/2010 | Page et al. |
| 2010/0144031 A1 | 6/2010 | Jaenisch et al. |
| 2010/0167286 A1 | 7/2010 | Reijo Pera et al. |
| 2010/0168000 A1 | 7/2010 | Kiessling et al. |
| 2010/0184033 A1 | 7/2010 | West et al. |
| 2010/0184227 A1 | 7/2010 | Thomson et al. |
| 2010/0221829 A1 | 9/2010 | Amit et al. |
| 2010/0233804 A1 | 9/2010 | Zhou et al. |
| 2010/0267141 A1 | 10/2010 | Shi et al. |
| 2010/0272695 A1 | 10/2010 | Agulnick et al. |
| 2010/0273220 A1 | 10/2010 | Yanik et al. |
| 2010/0304481 A1 | 12/2010 | Thomson et al. |
| 2010/0311171 A1 | 12/2010 | Nakanishi et al. |
| 2010/0317104 A1 | 12/2010 | Elefanty et al. |
| 2011/0045001 A1 | 2/2011 | Klosel et al. |
| 2011/0065103 A1 | 3/2011 | Sahin et al. |
| 2011/0076678 A1 | 3/2011 | Jaenisch et al. |
| 2011/0104125 A1 | 5/2011 | Yu |
| 2011/0110899 A1 | 5/2011 | Shi et al. |
| 2011/0143397 A1 | 6/2011 | Kariko et al. |
| 2011/0143436 A1 | 6/2011 | Dahl et al. |
| 2011/0145940 A1 | 6/2011 | Voytas et al. |
| 2011/0151557 A1 | 6/2011 | Reh et al. |
| 2011/0165133 A1 | 7/2011 | Rabinovich et al. |
| 2011/0171185 A1 | 7/2011 | Klimanskaya et al. |
| 2011/0189137 A1 | 8/2011 | Rana et al. |
| 2011/0236978 A1 | 9/2011 | Stolzing et al. |
| 2011/0239315 A1 | 9/2011 | Bonas et al. |
| 2011/0244566 A1 | 10/2011 | Wu et al. |
| 2011/0263015 A1 | 10/2011 | D'Costa et al. |
| 2011/0301073 A1 | 12/2011 | Gregory et al. |
| 2012/0046346 A1 | 2/2012 | Rossi et al. |
| 2012/0064620 A1 | 3/2012 | Bonas et al. |
| 2012/0195936 A1 | 8/2012 | Rudolph et al. |
| 2012/0208278 A1 | 8/2012 | Yanik et al. |
| 2012/0237975 A1 | 9/2012 | Schrum et al. |
| 2012/0301455 A1 | 11/2012 | Hunt |
| 2013/0102034 A1 | 4/2013 | Schrum et al. |
| 2013/0115272 A1 | 5/2013 | de Fougerolles et al. |
| 2013/0122581 A1 | 5/2013 | Voytas et al. |
| 2013/0123481 A1 | 5/2013 | de Fougerolles et al. |
| 2013/0156849 A1 | 6/2013 | de Fougerolles et al. |
| 2013/0165504 A1 | 6/2013 | Bancel et al. |
| 2013/0189741 A1 | 7/2013 | Meis et al. |
| 2013/0203115 A1 | 8/2013 | Schrum et al. |
| 2013/0217119 A1 | 8/2013 | Bonas et al. |
| 2013/0244282 A1 | 9/2013 | Schrum et al. |
| 2013/0245103 A1 | 9/2013 | de Fougerolles et al. |
| 2013/0302295 A1 | 11/2013 | Wang et al. |
| 2013/0345274 A1 | 12/2013 | Farber |
| 2014/0073053 A1 | 3/2014 | Yanik et al. |
| 2014/0073687 A1 | 3/2014 | Chien et al. |
| 2014/0194482 A1 | 7/2014 | Farber et al. |
| 2014/0242154 A1 | 8/2014 | Ramunas et al. |
| 2014/0242155 A1 | 8/2014 | Ramunas et al. |
| 2014/0315988 A1 | 10/2014 | Dahl et al. |
| 2014/0349401 A1 | 11/2014 | Wang et al. |

FOREIGN PATENT DOCUMENTS

| | | | |
|---|---|---|---|
| EP | 2320952 | 5/2011 | |
| JP | 2003306448 | 10/2003 | |
| WO | 9800551 | 1/1998 | |
| WO | 9830679 | 7/1998 | |
| WO | 0074763 | 12/2000 | |
| WO | 0226757 | 4/2002 | |
| WO | 02094251 | 11/2002 | |
| WO | 03086472 | 10/2003 | |
| WO | 2007024708 | 3/2007 | |
| WO | WO 2007/024708 | * 3/2007 | ............ A61K 48/00 |
| WO | 2008065381 | 6/2008 | |
| WO | 2009127230 | 10/2009 | |
| WO | 2009147400 | 12/2009 | |
| WO | 2010012472 | 2/2010 | |
| WO | 2010093655 | 8/2010 | |
| WO | 2010123501 | 10/2010 | |
| WO | 2010130447 | 11/2010 | |
| WO | 2011071931 | 6/2011 | |
| WO | 2011071936 | 6/2011 | |
| WO | 2011110886 | 9/2011 | |
| WO | 2011114237 | 9/2011 | |
| WO | 2011012316 | 10/2011 | |
| WO | 2011130624 | 10/2011 | |
| WO | 2011140397 | 11/2011 | |
| WO | 2011141820 | 11/2011 | |
| WO | 2011154393 | 12/2011 | |
| WO | 2012019122 | 2/2012 | |
| WO | 2012019168 | 2/2012 | |

(56) References Cited

FOREIGN PATENT DOCUMENTS

| WO | 2012036299 | 3/2012 |
|---|---|---|
| WO | 2012048213 | 4/2012 |
| WO | 2012060473 | 5/2012 |
| WO | 2012122318 | 9/2012 |
| WO | 2012131090 | 10/2012 |
| WO | 2012138453 | 10/2012 |
| WO | 2012174224 | 12/2012 |
| WO | 2012176015 | 12/2012 |
| WO | 2013003475 | 1/2013 |
| WO | 2013020064 | 2/2013 |
| WO | 2013053819 | 4/2013 |
| WO | 2013086008 | 6/2013 |
| WO | 2013102203 | 7/2013 |
| WO | 2013151671 | 10/2013 |
| WO | 2013163296 | 10/2013 |
| WO | 2013173248 | 11/2013 |
| WO | 2014015314 | 1/2014 |
| WO | 2014134412 | 9/2014 |
| WO | 2014190361 | 11/2014 |

OTHER PUBLICATIONS

Woodley et al., Intradermal injection of lentiviral vectors corrects regenerated human dystrophic epidermolysis bullosa skin tissue in vivo. Mol Ther. Aug. 2004;10(2):318-26.*

Fritsch et al., "Dominant-negative Effects of COL7A1 Mutations Can be Rescued by Controlled Overexpression of Normal Collagen VII," The Journal of Biological Chemistry, vol. 284, No. 44, pp. 30248-30256, Oct. 30, 2009.

Goto et al., "Targeted Skipping of a Single Exon Harboring a Premature Termination Codon Mutation: Implications and Potential for Gene Correction Therapy for Selective Dystrophic Epidermolysis Bullosa Patients," Journal of Investigative Dermatology, vol. 126, pp. 2614-2620, Jun. 15, 2006.

Kern et al., "Mechanisms of Fibroblast Cell Therapy for Dystrophic Epidermolysis Bullosa: High Stability of Collagen VII Favors Long-term Skin Integrity," Molecular Therapy, vol. 17, No. 9, pp. 1605-1615, Sep. 2009.

Murauer et al., "Functional Correction of Type VII Collagen Expression in Dystrophic Epidermolysis Bullosa," Journal of Investigative Dermatology, vol. 131, pp. 74-83, 2011.

Osborn et al., "Talen-based Gene Correction for Epidermolysis Bullosa," Molecular Therapy, vol. 21, No. 6, pp. 1151-1159, Jun. 2013.

Titeux et al., "Gene Therapy for Recessive Dystrophic Epidermolysis Bullosa," Dermatologic Clinics, vol. 28, pp. 361-366, Feb. 3, 2010.

Tolar, et al., "Patient-Specific Naturally Gene-Reverted Induced Pluripotent Stem Cells in Recessive Dystrophic Epidermolysis Bullosa," Journal of Investigative Dermatology, vol. 134, pp. 1246-1254, Jan. 9, 2014.

Wally et al., "Spliceosome-Mediated Trans-Splicing: The Therapeutic Cut and Paste," Journal of Investigative Dermatology, vol. 132, pp. 1959-1966, Apr. 12, 2012.

Ludwig et al., "Derivation of human embryonic stem cells in defined conditions," Nat. Biotechnol. 24, pp. 185-187 (Feb. 2006).

Ludwig et al., "Feeder-independent culture of human embryonic stem cells," Nat. Methods 3, pp. 637-646 (Aug. 2006).

Mahfouz et al., "De novo-engineered transcription activator-like effector (TALE) hybrid nuclease witgh novel DNA binding specificity creates double-strand breaks," PNAS vol. 108, No. 6, pp. 2623-2628 (Feb. 8, 2011).

Miller et al., "A TALE nuclease architecture for efficient genome editing," Nature Biotechnology, vol. 29, No. 2, pp. 143-148 (Feb. 2011).

Miller et al., "An improved zinc-finger nuclease architecture for highly specific genome editing," Nat. Biotechnol.; vol. 25, No. 7, pp. 778-785 (Jul. 2007).

MIT Thesis Record, "Reprogramming human somatic cells to pluripotency using RNA," (Matthew Angel, author) (May 15, 2012).

Moscou et al., "A Simple Cipher Governs DNA Recognition by TAL Effectors," Science, vol. 326, p. 1501 (Dec. 11, 2009).

Ng et al., "A protocol describing the use of a recombinant protein-based, animal product-free medium (APEL) for human embryonic stem cell differentiation as spin embryoid bodies," Nat. Protoc. 3, pp. 768-776 (Apr. 10, 2008).

Okita et al., "Generation of germline-competent induced pluripotent stem cells," Nature, vol. 448, pp. 313-317 (Jul. 19, 2007).

Plews et al., "Activation of pluripotency genes in human fibroblast cells by a novel mRNA based approach," PLoS One 5:e14397, pp. 1-10 (Dec. 2010).

Porteus et al., "Gene targeting using zinc finger nucleases," Nat. Biotechnol., vol. 23, No. 8,, pp. 967-973 (2005).

Rossi et al., "Anti-inflammatory cyclopentenone prostaglandins are direct inhibitors of IkB kinase," Nature, vol. 403, pp. 103-108 (Jan. 6, 2000).

Sander et al., "Targeted gene disruption in somatic zebrafish cells using engineered TALENs," Author Manuscript, available in PMC on Feb. 5, 2012. Published in final edited form as: Nat Biotechnol. ; 29(8): 697-698. doi:10.1038/nbt.1934.

Sanjana et al., "A transcription activator-like effector toolbox for genome engineering," Nature Protocols, vol. 7, No. 1, pp. 171-192 (2012).

Scheider et al., "An effective method for defatting albumin using resin columns," Biochim. Biophys. Acta, 221; 376-378 (1970).

Schwartz et al., "Embryonic stem cell trials for macular degeneration: a preliminary report," Lancet, pp. 1-8 (Jan. 23, 2012).

Shimizu et al., "Transformation by Wnt Family Proteins Correlates with Regulation of β-Catenin," Cell Growth & Differentiation, vol. 8, pp. 1349-1358 (Dec. 1997).

Soldner et al., "Generation of isogenic pluripotent stem cells differing exclusively at two early onset Parkinson point mutations," Author Manuscript, available in PMC on Jul. 22, 2012. Published in final edited form as: Cell. Jul. 22, 2011; 146(2): 318-331. doi:10.1016/j.cell.2011.06.019.

Takahashi et al., "Induction of pluripotent stem cells from adult human fibroblasts by defined factors," Cell 131, pp. 1-12 (Nov. 30, 2007).

Takahashi, et al., "Induction of pluripotent stem cells from mouse embryonic and adult fibroblast cultures by defined factors," Cell 126, pp. 1-14 (Aug. 25, 2006).

Tesson et al., "Knockout rats generated by embryo microinjection of TALENs," Nature Biotechnology, vol. 29, No. 8, pp. 695-696 (Aug. 2011).

Warren et al., "Highly efficient reprogramming to pluripotency and directed differentiation of human cells with synthetic modified mRNA," Cell. Stem Cell 7, pp. 1-13 (Nov. 5, 2010).

Watanabe et al., "A Rock inhibitor permits survival of dissociated human embryonic stem cells," Nature Biotechnology, vol. 25, No. 6, pp. 681-686 (Jun. 2007).

Wernig et al., "In vitro reprogramming of fibroblasts into a pluripotent ES-cell-like state," Nature, vol. 448, pp. 317-324 (Jul. 19, 2007).

Wood et al., "Targeted Genome Editing Across Species Using ZFNs and TALENs," Science, vol. 333, p. 307 (Jul. 15, 2011).

"Xeno-Free System for hESC & hiPSC. Facilitating the Shift from Stem Cell Research to Clincal Applications." 12 pages, Biological Industries Catalog (Stem Cell Products) (2011).

Xie et al., "Newly expressed proteins of mouse embryonic fibroblasts irradiated to be inactive," Biochem. Biophys. Res. Commun. 315, pp. 581-588 (2004).

Yakubov et al., "Reprogramming of human fibroblasts to pluripotent stem cells using mRNA of four transcription factors," Biochem. Biophys. Res. Commun. 394, pp. 189-193 (2010).

You et al., "Wnt signaling promotes oncogenic transformation by inhibiting c-Myc-induced apoptosis," The Journal of Cell Biology, vol. 157, No. 3, pp. 429-440 (Apr. 29, 2002).

Young et al., "Background Mutations in Parental Cells Account for Most of the Genetic Heterogeneity of Induced Pluripotent Stem Cells," Cell Stem Cell 10, pp. 570-582 (May 4, 2012).

(56) References Cited

OTHER PUBLICATIONS

Yu et al., "Induced pluripotent stem cell lines derived from human somatic cells," Science 318, pp. 1917-1920 (Dec. 21, 2007).
Zhou et al., "Generation of Induced Pluripotent Stem Cells Using Recombinant Proteins," Cell Stem Cell 4, pp. 1-4 (May 8, 2009).
International Search Report, PCT/US15/13949, dated May 21, 2015, 4 pages.
Wei, et al., "An Electroporation Chip Based on Flexible Microneedle Array for In Vivo Nucleic Acid Delivery," MEMS, 2014, San Francisco, CA, USA, Jan. 26-30, 2014, pp. 817-820.
Potter et al., "Transfection by Electroporation," Curr Protoc Mol Biol., May 2003, Chapter: Unit—.3. doi:10.1002/0471142727.mb0903s62, pp. 1-12.
Albumax I product insert, Invitrogen Corporation (Jun. 2001), 1 page.
Anderson et al., "Incorporation of pseudouridine into mRNA enhances translation by diminishing PKR activation," Nucl. Acids Res. 38(17), pp. 1-9 (2010).
Anderson et al., "Nucleofection induces transient eiF2a phosphorylation by GCN2 and PERK," Gene Ther., pp. 1-7 (Feb. 2, 2012).
Anderson et al., "Nucleoside modifications in RNA limit activation of 2'-5'-oligoadenylate synthetase and increase resistance to cleavage by RNase L," Nucl. Acids Res. 39(21), pp. 9329-9338 (2011).
Angel et al., "Innate Immune Suppression Enables Frequent Transfection with RNA Encoding Reprogramming Proteins," PLoS ONE, vol. 5(7), e11756, pp. 1-7 (Jul. 2010).
Angel, "Extended Transient Transfection by Repeated Delivery of an In Vitro-Transcribed RNA," Master of Science in Electrical Engineering and Computer Science, 56 pages (Massachusetts Institute of Technology, Cambridge, Massachusetts) (Sep. 2008).
Angel, "Reprogramming Human Somatic Cells to Pluripotency Using RNA", pp. 1-89 (Ph.D. diss., Massachusetts Institute of Technology) (Feb. 2012).
Angel, "Reprogramming human somatic cells to pluripotency using RNA," Doctor of Philosophy in Electrical Engineering and Computer Science, 55 pages (Massachusetts Institute of Technology, Cambridge, Massachusetts) (Oct. 11, 2011).
Arnold et al., "Reprogramming of Human Huntington Fibroblasts Using mRNA," ISRN Cell Biology 2012:Article ID 124878, pp. 1-12 (2012).
Barker et al., "A method for the deionization of bovine serum albumin," Tissue Culture Association, pp. 111-112 (1975).
Berg, "Proposed structure for the zinc-binding domains from transcription factor IIIA and related proteins," Proc. Natl. Acad. Sci. USA, vol. 85, pp. 99-102 (Jan. 1988).
Boch et al., "Breaking the Code of DNA Binding Specificity of TAL-Type III Effectors," Science, vol. 3126, pp. 1509-1512 (Dec. 11, 2009).
Bolli et al., "Cardiac stem cells in patients with ischaemic cardiomyopathy (SCIPIO): initial results of a randomised phase 1 trial," Lancet, pp. 1-11 (Nov. 14, 2011).
Braam et al., "Recombinant vitronectin is a functionally defined substrate that supports human embryonic stem cell self-renewal via αυ β5 integrin," Stem Cells 26, pp. 2257-2265 (2008).
Carroll, "Progress and prospects: Zinc-finger nucleases as gene therapy agents," Gene Therapy, vol. 15, pp. 1463-1468 (2008).
Chen et al., "Chemically defined conditions for human iPSC derivation and culture," Nat. Methods 8, pp. 424-429 (May 2011).
Chen et al., "Rational optimization of reprogramming culture conditions for the generation of induced pluripotent stem cells with ultra-high efficiency and fast kinetics," Cell Research 21, pp. 884-894 (2011).
Christian et al., "Targeting DNA Double-Strand Breaks with TAL Effector Nucleases," Genetics, vol. 186, pp. 757-761 (Oct. 2010).
Cui et al., "Targeted integration in rat and mouse embryos with zinc-finger nucleases," Nat. Biotech., vol. 29, No. 1, pp. 64-67 (Jan. 2011).
Davis, "Stabilization of RNA stacking by pseudouriding," Nucleic Acids Research, vol. 23, No. 24, pp. 5020-5026 (1995).
Droge et al., "A comparative study of some physico-chemical properties of human serum albumin samples from different sources—I. Some physico-chemical properties of isoionic human serum albumin solutions," Biochem. Pharmacal. 31, pp. 3775-3779 (1982).
Efe et al., "Conversion of mouse fibroblasts into cardiomyocytes using a direct reprogramming strategy," Nat. Cell Biol. 13, pp. 215-222 (Mar. 2011).
Garcia-Gonzalo et al., "Albumin-associated lipids regulate human embryonic stem cell self-renewal," PLoS One 3: e1384, pp. 1-10 (Jan. 2008).
Geurts et al., "Knockout Rats via Embryo Microinjection of Zinc-Finger Nucleases," Science, vol. 325, p. 433 (Jul. 24, 2009).
Goldberg et al., "The incorporation of 5-ribosyluracil triphosphate into RNA in nuclear extracts of mammalian cells," Biochem. Biophys. Res. Commun. 6, pp. 394-398 (1961).
Goldberg et al., "The enzymic synthesis of pseudouridine triphosphate," Biochim. Biophys. Acta, vol. 54, pp. 202-204 (1961).
Goldberg, "Ribonucleic acid synthesis in nuclear extracts of mammalian cells grown in suspension culture; effect of ionic strength and surface-active agents," Biochim. Biophys. Acta, vol. 51, pp. 201-204 (1961).
Gurung et al., "β-Catenin Is a Mediator of the Response of Fibroblasts to Irradiation," The American Journal of Pathology, vol. 174, No. 1, pp. 248-255 (Jan. 2009).
Hamanaka et al., "Generation of Germline-Component Rat Induced Pluripotent Stem Cells," PlosOne, vol. 6, Issue 7, pp. 1-9 (Jul. 2011).
Hockemeyer et al., "Efficient targeting of expressed and silent genes in human ESCs and iPSCs using zinc-finger nucleases," Nature Biotechnology, vol. 27, No. 9, pp. 851-857 (Sep. 2009).
Hockemeyer et al., "Genetic engineering of human ES and iPS cells using TALE nucleases," Author Manuscript, available in PMC Feb. 1, 2012. Published in final edited form as: Nat Biotechnol. ; 29(8): 731-734. doi:10.1038/nbt.1927.
International Search Report, PCT/US2013/068118, 4 pages dated Mar. 27, 2014.
Kahan et al., "The Role of Deoxyribonucleic Acid in Ribonucleic Acid Synthesis," The Journal of Biological Chemistry, vol. 237, No. 12, pp. 3778-3785 (Dec. 1962).
Kariko et al., "Generating the optimal mRNA for therapy: HPLC purification eliminates immune activation and improves translation of nucleoside-modified, protein-encoding mRNA," Nucl. Acids Res., pp. 1-10 (Sep. 2, 2011).
Kariko et al., "In vivo protein expression from mRNA delivered into adult rat brain," J. Neurosci. Methods 105, pp. 77-86 (2001).
Kariko et al., "Incorporation of pseudouridine into mRNA yields superior nonimmunogenic vector with increased translational capacity and biological stability," Mol. Ther. 16, pp. 1833-1840 (2008).
Kariko et al., "Increased Erythropoiesis in Mice Injected With Submicrogram Quantities of Pseudouridine-containing mRNA Encoding Erythropoietin," Mol. Ther. 20, pp. 948-953 (May 2012).
Kariko et al., "mRNA is an endogenous ligand for Toll-like receptor 3," J. Biol. Chern. 279, pp. 12542-12550 (2004).
Kariko et al., "Naturally occurring nucleoside modifications suppress the immunostimulatory activity of RNA: Implication for therapeutic RNA development," Drug Discovery & Development, vol. 10, No. 5, pp. 523-532 (2007).
Kariko et al., "Suppression of RNA recognition by Toll-like receptors: the impact of nucleoside modification and the evolutionary origin of RNA," Immunity 23, pp. 165-175 (2005).
Kawamata et al., "Generation of genetically modified rats from embryonic stem cells," PNAS, vol. 107, No. 32, pp. 14223-14228 (Aug. 10, 2010).
Kim et al., "Direct reprogramming of human neural stem cells by OCT4," Nature 461, pp. 649-653 (Oct. 2009).
Kim et al., "Generation of Human Induced Pluripotent Stem Cells by Direct Delivery of Reprogramming Proteins," Cell Stem Cell 4, pp. 472-476 (Jun. 5, 2009).
Kim et al., "Hybrid restriction enzymes: Zinc finger fusions to Fok I cleavage domain," Proc. Natl. Acad. Sci. USA, vol. 93, pp. 1156-1160 (Feb. 1996).

(56) References Cited

OTHER PUBLICATIONS

Kim et al., "Oct4-induced pluripotency in adult neural stem cells," Cell 136, pp. 411-419 (Feb. 6, 2009).
Kim et al., "Pluripotent stem cells induced from adult neural stem cells by reprogramming with two factors," Nature 454, pp. 1-6 (2008).
Lee et al., "Activation of Innate Immunity Is Required for Efficient Nuclear Reprogramming," Cell 151, pp. 547-558 (Oct. 26, 2012).
Lin et al., "A chemical platform for improved induction of human iPSCs," Nature Methods, vol. 6, No. 11, pp. 805-808 (Nov. 2009).
Liu et al., "A Small-Molecule Agonist of the Wnt Signaling Pathway," Angew. Chem. Int. Ed. 44, pp. 1987-1990 (2005).
Lu et al., "Defined culture conditions of human embryonic stem cells," PNAS 2006, vol. 103, pp. 5688-5693 (Apr. 11, 2006).
Goto et al., "Fibroblasts Show More Potential as Target Cells than Keratinocytes in COL7A1 Gene Therapy of Dystrophic Epidermolysis Bullosa", Journal of Investigative Dermatology (2006) 126, 766-772.
Wong, et al., "Potential of Fibroblast Cell Therapy for Recessive Dystrophic Epidermolysis Bullosa", Journal of Investigative Dermatology (2008) 128, 2179-2189.

\* cited by examiner

TYR RNA

Ephelis

METHODS AND PRODUCTS FOR NUCLEIC ACID PRODUCTION AND DELIVERY

PRIORITY

The present application is a U.S. National Phase Application of PCT/US15/13949, filed Jan. 30, 2015 and claims priority to U.S. Provisional Application No. 61/934,397, filed on Jan. 31, 2014, U.S. Provisional Application No. 62/038,608, filed on Aug. 18, 2014, and U.S. Provisional Application No. 62/069,667, filed on Oct. 28, 2014, the entire contents of which are hereby incorporated by reference in their entireties.

The present application is related to U.S. application Ser. No. 13/465,490, filed on May 7, 2012, International Application No. PCT/US2012/067966, filed on Dec. 5, 2012, U.S. application Ser. No. 13/931,251, filed on Jun. 28, 2013, and International Application No. PCT/US2013/068118, filed on Nov. 1, 2013, the entire contents of which are hereby incorporated by reference in their entireties.

FIELD OF THE INVENTION

The present invention relates, in part, to methods, compositions, and products for producing and delivering nucleic acids to cells, tissues, organs, and patients, methods for expressing proteins in cells, tissues, organs, and patients, and cells, therapeutics, and cosmetics produced using these methods, compositions, and products.

DESCRIPTION OF THE TEXT FILE SUBMITTED ELECTRONICALLY

The contents of the text file submitted electronically herewith are incorporated herein by reference in their entirety: A computer readable format copy of the Sequence Listing (filename: FAB-008PC SequenceListing.txt; date recorded: Aug. 27, 2015; file size: 1020 KB).

BACKGROUND

Synthetic RNA and Nucleic-Acid Therapeutics

Ribonucleic acid (RNA) is ubiquitous in both prokaryotic and eukaryotic cells, where it encodes genetic information in the form of messenger RNA, binds and transports amino acids in the form of transfer RNA, assembles amino acids into proteins in the form of ribosomal RNA, and performs numerous other functions including gene expression regulation in the forms of microRNA and long non-coding RNA. RNA can be produced synthetically by methods including direct chemical synthesis and in vitro transcription, and can be administered to patients for therapeutic use. However, previously described synthetic RNA molecules are unstable and trigger a potent innate-immune response in human cells. In addition, methods for efficient non-viral delivery of nucleic acids to patients, organs, tissues, and cells in vivo have not been previously described. The many drawbacks of existing synthetic RNA technologies and methods for delivery of nucleic acids make them undesirable for therapeutic or cosmetic use.

Cell Reprogramming and Cell-Based Therapies

Cells can be reprogrammed by exposing them to specific extracellular cues and/or by ectopic expression of specific proteins, microRNAs, etc. While several reprogramming methods have been previously described, most that rely on ectopic expression require the introduction of exogenous DNA, which can carry mutation risks. DNA-free reprogramming methods based on direct delivery of reprogramming proteins have been reported. However, these methods are too inefficient and unreliable for commercial use. In addition, RNA-based reprogramming methods have been described (See, e.g., Angel. MIT Thesis. 2008. 1-56; Angel et al. PLoS ONE. 2010. 5, 107; Warren et al. Cell Stem Cell. 2010. 7, 618-630; Angel. MIT Thesis. 2011. 1-89; and Lee et al. Cell. 2012. 151, 547-558; the contents of all of which are hereby incorporated by reference). However, existing RNA-based reprogramming methods are slow, unreliable, and inefficient when performed on adult cells, require many transfections (resulting in significant expense and opportunity for error), can reprogram only a limited number of cell types, can reprogram cells to only a limited number of cell types, require the use of immunosuppressants, and require the use of multiple human-derived components, including blood-derived HSA and human fibroblast feeders. The many drawbacks of previously disclosed RNA-based reprogramming methods make them undesirable for in vivo use.

Gene Editing

Several naturally occurring proteins contain DNA-binding domains that can recognize specific DNA sequences, for example, zinc fingers (ZFs) and transcription activator-like effectors (TALEs). Fusion proteins containing one or more of these DNA-binding domains and the cleavage domain of FokI endonuclease can be used to create a double-strand break in a desired region of DNA in a cell (See, e.g., US Patent Appl. Pub. No. US 2012/0064620, US Patent Appl. Pub. No. US 2011/0239315, U.S. Pat. No. 8,470,973, US Patent Appl. Pub. No. US 2013/0217119, U.S. Pat. No. 8,420,782, US Patent Appl. Pub. No. US 2011/0301073, US Patent Appl. Pub. No. US 2011/0145940, U.S. Pat. No. 8,450,471, U.S. Pat. No. 8,440,431, U.S. Pat. No. 8,440,432, and US Patent Appl. Pub. No. US 2013/0122581, the contents of all of which are hereby incorporated by reference). However, current methods for gene editing cells are inefficient and carry a risk of uncontrolled mutagenesis, making them undesirable for both research and therapeutic use. Methods for DNA-free gene editing of somatic cells have not been previously explored, nor have methods for simultaneous or sequential gene editing and reprogramming of somatic cells. In addition, methods for directly gene editing cells in patients (i.e., in vivo) have not been previously explored, and the development of such methods has been limited by a lack of acceptable targets, inefficient delivery, inefficient expression of the gene-editing protein/proteins, inefficient gene editing by the expressed gene-editing protein/proteins, due in part to poor binding of DNA-binding domains, excessive off-target effects, due in part to non-directed dimerization of the FokI cleavage domain and poor specificity of DNA-binding domains, and other factors.

Finally, the use of gene editing in anti-bacterial, anti-viral, and anti-cancer treatments has not been previously explored.

Accordingly, there remains a need for improved methods and compositions for the production and delivery of nucleic acids to cells, tissues, organs, and patients.

SUMMARY OF THE INVENTION

The present invention provides, in part, compositions, methods, articles, and devices for delivering nucleic acids to cells, tissues, organs, and patients, methods for inducing cells to express proteins, methods, articles, and devices for producing these compositions, methods, articles, and devices, and compositions and articles, including cells, organisms, cosmetics and therapeutics, produced using these compositions, methods, articles, and devices. Unlike previously reported methods, certain embodiments of the present invention do not involve exposing cells to exogenous DNA or to allogeneic or animal-derived materials, making products produced according to the methods of the present invention useful for therapeutic and cosmetic applications.

In some aspects, there is provided a method for expressing a protein in a cell population of a patient, comprising introducing an RNA into the cell population, the RNA comprising one or more non-canonical nucleotides that do not induce significant cellular immune response and do not substantially reduce protein expression. In some embodiments, at least 50%, or at least 75%, or at least 90% of the non-canonical nucleotides are selected from one or more of 5-hydroxycytidine, 5-hydroxymethylcytidine, 5-carboxycytidine, 5-formylcytidine, 5-hydroxyuridine, 5-hydroxymethyluridine, 5-carboxyuridine, and 5-formyluridine, or in some embodiments selected from one or more of 5-hydroxymethylcytidine, 5-carboxycytidine, and 5-formylcytidine. Further embodiments relate to additional elements of the RNA, e.g. a 5' cap structure, a 3' poly(A) tail, and 5'-UTR and/or 3'-UTR, which optionally comprises one or more of a Kozak consensus sequence, a sequence that increases RNA stability in vivo (such as, by way of illustration, an alpha-globin or beta-globin 5'-UTR).

In some aspects, nucleic acid delivery patches are provided. In one aspect, devices for delivering nucleic acids using electric fields are provided. Other aspects pertain to methods and compositions for delivery of nucleic acids to the skin. Still further aspects pertain to methods and compositions for expression of proteins in the skin.

In one aspect, the invention provides methods and compositions for treating diseases and conditions in humans, including, but not limited to, prophylactic treatments, treatments for rare diseases, including, but not limited to, dermatologic rare diseases, and treatments for use in medical dermatology and aesthetic medicine. In another aspect, the invention provides cosmetics comprising nucleic acids. Still further aspects relate to methods and compositions for altering pigmentation, for example, for the treatment of pigmentation disorders. Still further aspects relate to methods and compositions for enhancing healing, including, but not limited to, healing in response to a wound or surgery. Other aspects relate to nucleic acids comprising one or more non-canonical nucleotides. In one aspect, the invention provides nucleic acids comprising, for example, one or more of 5-hydroxycytidine, 5-hydroxymethylcytidine, 5-carboxycytidine, 5-formylcytidine, 5-hydroxyuridine, 5-hydroxymethyluridine, 5-carboxyuridine, and 5-formyluridine, or in some embodiments selected from one or more of 5-hydroxymethylcytidine, 5-carboxycytidine, and/or 5-formylcytidine.

The compositions of the present invention may alter, modify and/or change the appearance of a member of the integumenary system of a subject such as, but not limited to, skin, hair and nails. Such alteration, modification and/or change may be in the context of treatment methods and/or therapeutic uses as described herein including, by way of non-limiting example, dermatological treatments and cosmetics procedures.

In some aspects, synthetic RNA molecules with low toxicity and high translation efficiency are provided. In one aspect, a cell-culture medium for high-efficiency in vivo transfection, reprogramming, and gene editing of cells is provided. Other aspects pertain to methods for producing synthetic RNA molecules encoding reprogramming proteins. Still further aspects pertain to methods for producing synthetic RNA molecules encoding gene-editing proteins.

In one aspect, the invention provides high-efficiency gene-editing proteins comprising engineered nuclease cleavage domains. In another aspect, the invention provides high-fidelity gene-editing proteins comprising engineered nuclease cleavage domains. Other aspects relate to high-efficiency gene-editing proteins comprising engineered DNA-binding domains. Still further aspects pertain to high-fidelity gene-editing proteins comprising engineered DNA-binding domains. Still further aspects relate to gene-editing proteins comprising engineered repeat sequences. Some aspects relate to methods for altering the DNA sequence of a cell by transfecting the cell with or inducing the cell to express a gene-editing protein. Other aspects relate to methods for altering the DNA sequence of a cell that is present in an in vitro culture. Still further aspects relate to methods for altering the DNA sequence of a cell that is present in vivo.

In some aspects, the invention provides methods for treating cancer comprising administering to a patient a therapeutically effective amount of a gene-editing protein or a nucleic-acid encoding a gene-editing protein. In one aspect, the gene-editing protein is capable of altering the DNA sequence of a cancer associated gene. In another aspect, the cancer-associated gene is the BIRC5 gene. Still other aspects relate to therapeutics comprising nucleic acids and/or cells and methods of using therapeutics comprising nucleic acids and/or cells for the treatment of, for example, type 1 diabetes, heart disease, including ischemic and dilated cardiomyopathy, macular degeneration, Parkinson's disease, cystic fibrosis, sickle-cell anemia, thalassemia, Fanconi anemia, severe combined immunodeficiency, hereditary sensory neuropathy, xeroderma pigmentosum, Huntington's disease, muscular dystrophy, amyotrophic lateral sclerosis, Alzheimer's disease, cancer, and infectious diseases including hepatitis and HIV/AIDS. In some aspects, the nucleic acids comprise synthetic RNA. In other aspects, the nucleic acids are delivered to cells using a virus. In some aspects, the virus is a replication-competent virus. In other aspects, the virus is a replication-incompetent virus.

The details of the invention are set forth in the accompanying description below. Although methods and materials similar or equivalent to those described herein can be used in the practice or testing of the present invention, illustrative methods and materials are now described. Other features, objects, and advantages of the invention will be apparent from the description and from the claims. In the specification and the appended claims, the singular forms also include the plural unless the context clearly dictates otherwise. Unless defined otherwise, all technical and scientific terms used herein have the same meaning as commonly understood by one of ordinary skill in the art to which this invention belongs.

DETAILED DESCRIPTION OF THE FIGURES

Figure 7:
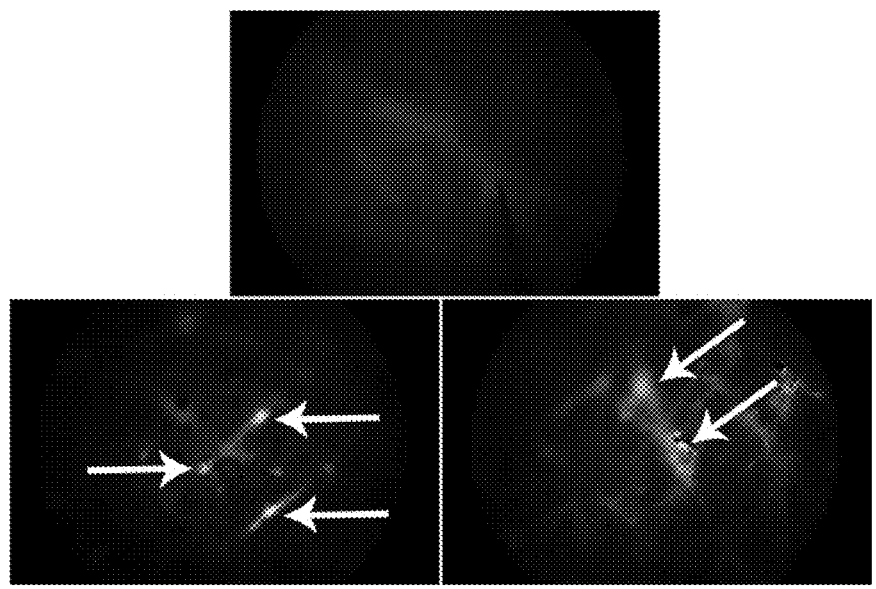

FIG. 7 depicts a region of the ventral forearm of a healthy, 33 year-old, male patient treated with synthetic RNA comprising 5-hydroxymethylcytidine ("5hmC") and encoding GFP. The top panel shows an untreated area on the same forearm, while the bottom panels show two fields within the treatment area. Fluorescent cells (indicated with arrows) are clearly visible in the bottom panels.

Figure 8:
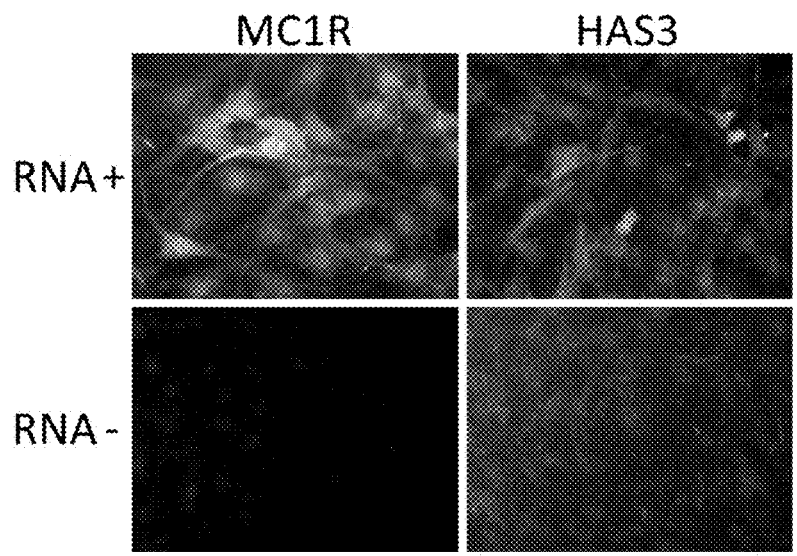

FIG. 8 depicts primary human dermal fibroblasts transfected with synthetic RNA comprising 5-methyluridine and 5-hydroxymethylcytidine and encoding the indicated protein. Cells were fixed and stained using antibodies targeting the indicated protein 48 hours after transfection.

Figure 9:
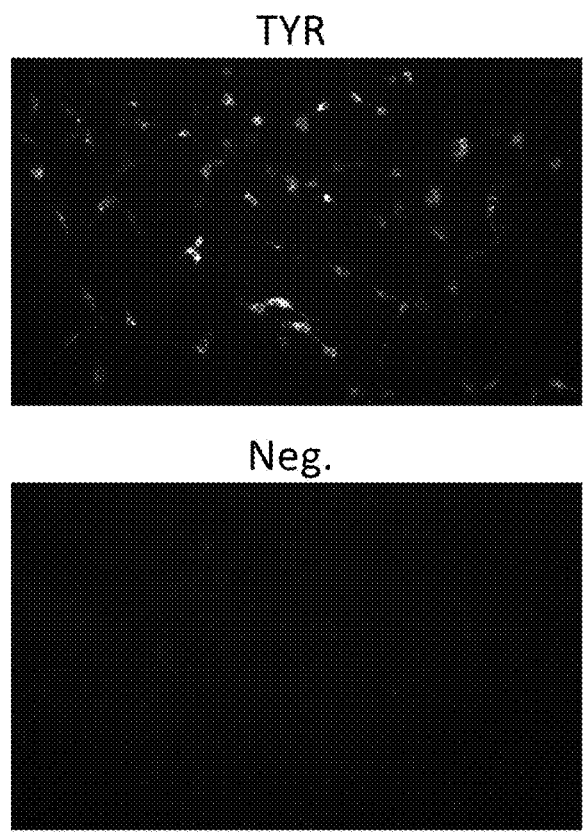

FIG. 9 depicts primary human dermal fibroblasts transfected with synthetic RNA comprising 5-methyluridine and 5-hydroxymethylcytidine and encoding human tyrosinase. Cells were fixed and stained using an antibody targeting human tyrosinase 24 hours after transfection.

Figure 10:
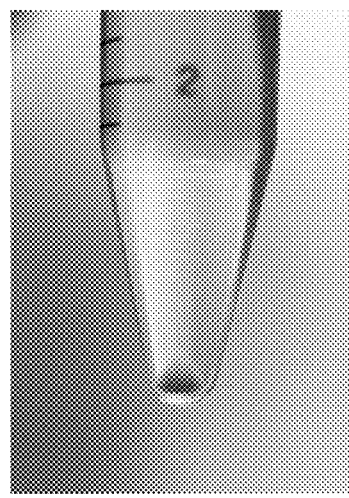

FIG. 10 depicts primary human epidermal melanocytes.

Figure 11:
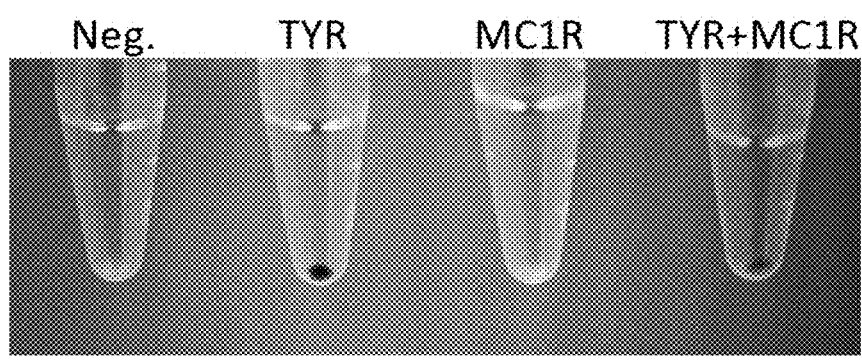

FIG. 11 depicts primary human dermal fibroblasts transfected with synthetic RNA comprising 5-hydroxymethylcytidine and encoding the indicated proteins.

Figure 12:
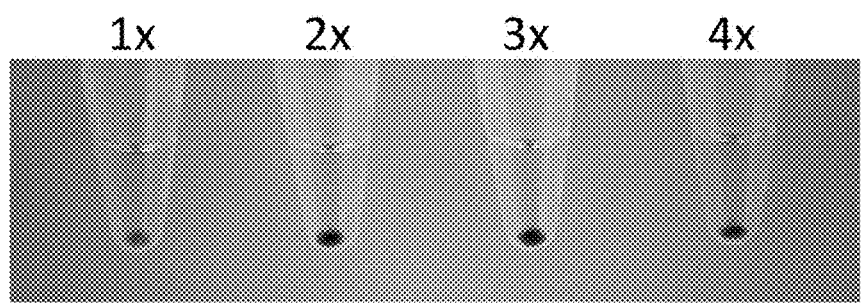

FIG. 12 depicts primary human dermal fibroblasts transfected daily with synthetic RNA comprising 5-hydroxymethylcytidine and encoding human tyrosinase. The number of transfections are shown above each sample. The cells were imaged 48 hours after the final transfection.

Figure 13:
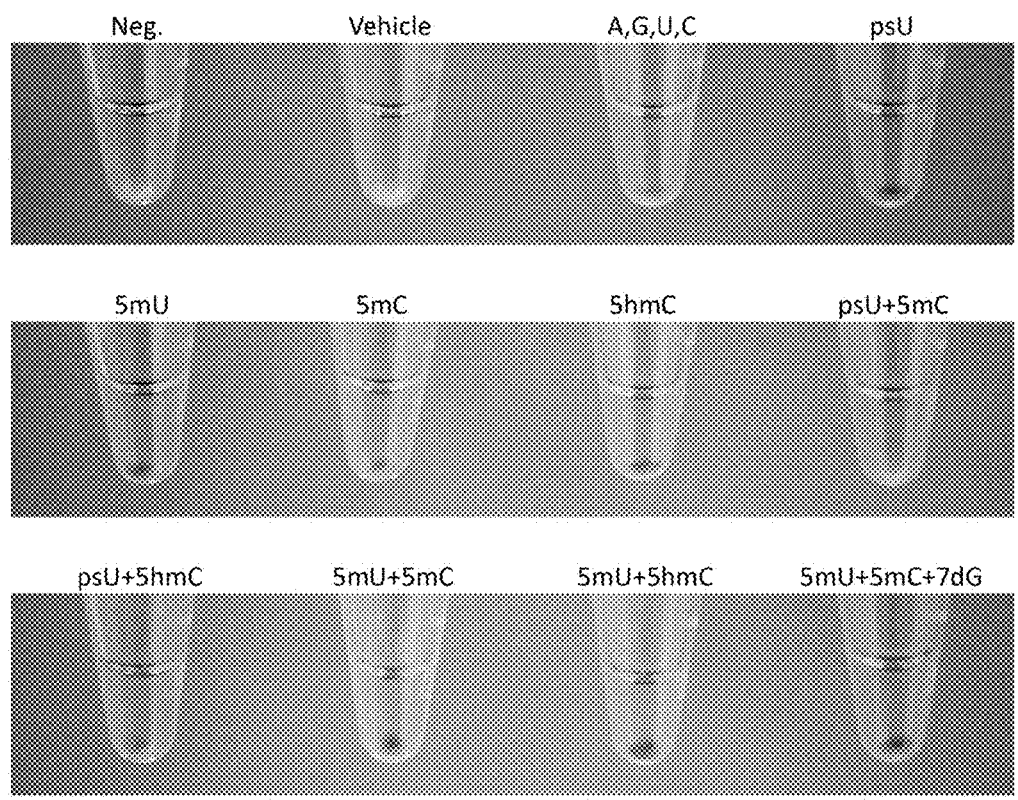

FIG. 13 depicts primary human dermal fibroblasts transfected daily with synthetic RNA comprising the indicated nucleotides and encoding human tyrosinase. The cells were imaged 48 hours after transfection.

Figure 14:
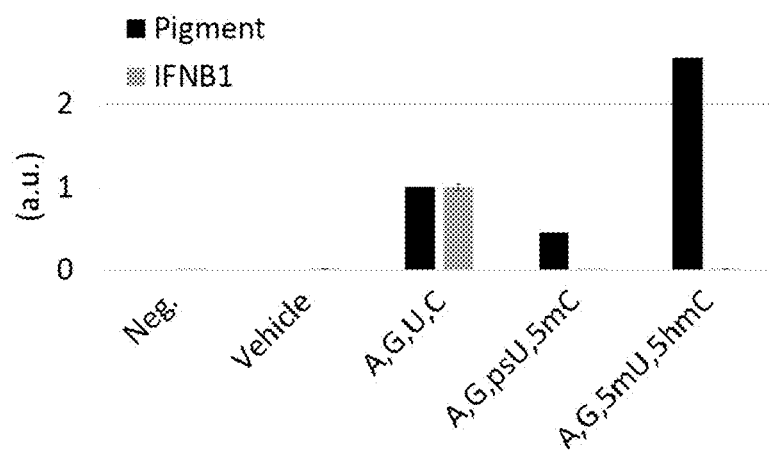

FIG. 14 depicts IFNB1 expression and pigment production in primary human dermal fibroblasts transfected with synthetic RNA comprising the indicated nucleotides and encoding human tyrosinase. Values are normalized to the sample transfected with synthetic RNA comprising only canonical nucleotides ("A,G,U,C"). GAPDH was used as a loading control. Error bars indicate standard error (n=2).

Figure 15:
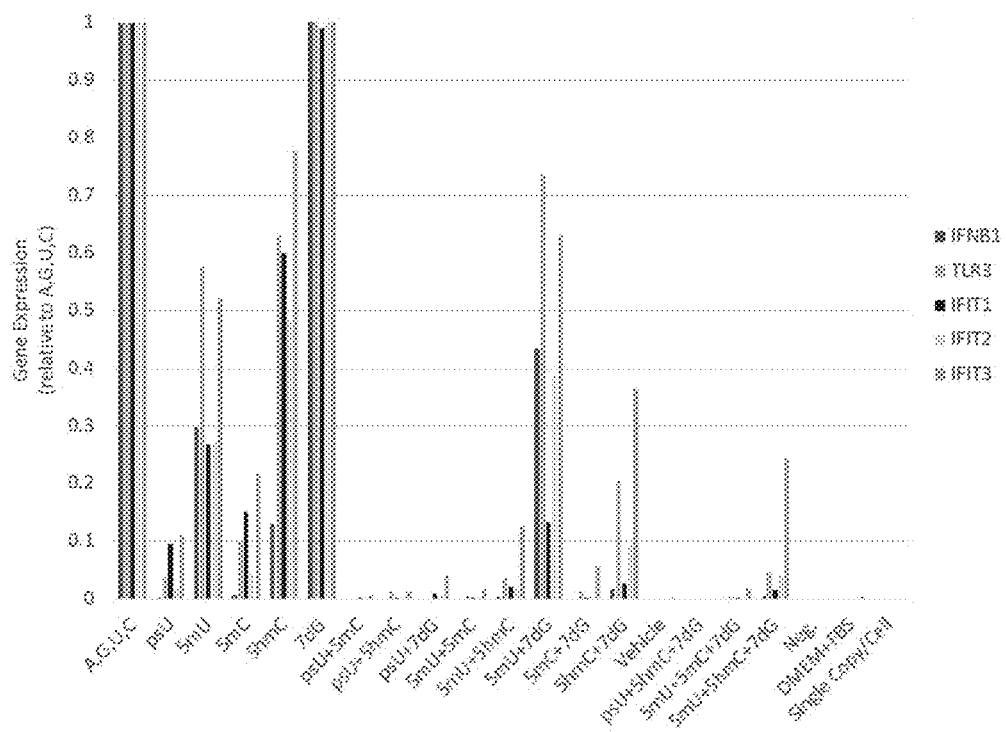

FIG. 15 depicts expression of the indicated genes, measured as in FIG. 14.

Figure 16:
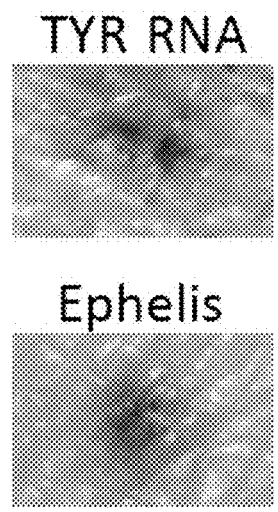

FIG. 16 depicts a region of the ventral forearm of a healthy, 33 year-old, male human subject treated with synthetic RNA comprising 5-methyluridine and 5-hydroxymethylcytidine and encoding human tyrosinase (top panel), and an ephelis on the ventral forearm of the same subject (bottom panel). The same magnification was used for both images.

Figure 17:
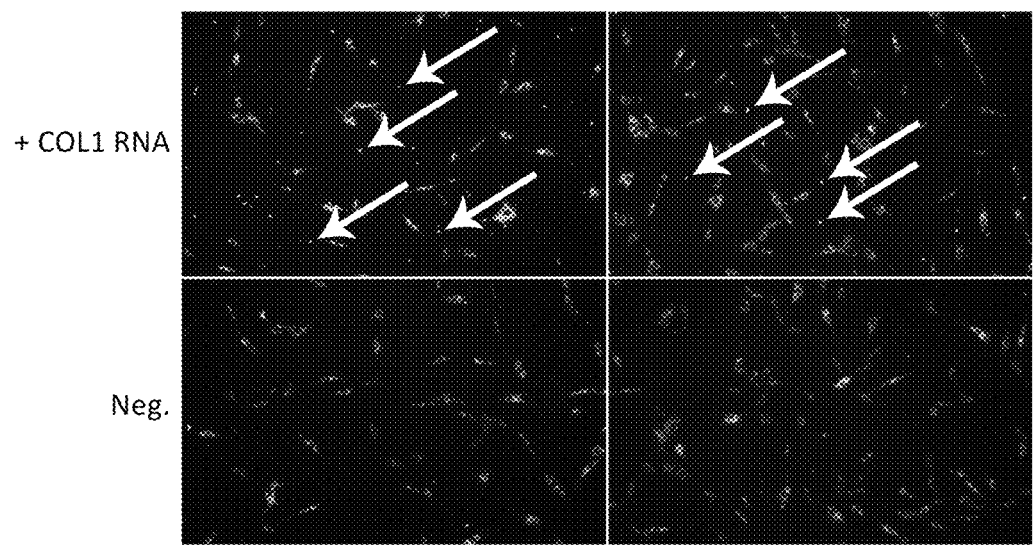

FIG. 17 depicts primary human dermal fibroblasts transfected with synthetic RNA comprising 5-hydroxymethylcytidine and encoding collagen I (A1) ("+COL1 RNA"). Cells were fixed and stained using an antibody targeting collagen I between 24 and 72 hours after transfection. Two representative fields are shown for each of: the transfected cells and un-transfected cells ("Neg."). Arrows indicate extracellular deposits of collagen I.

Figure 18:
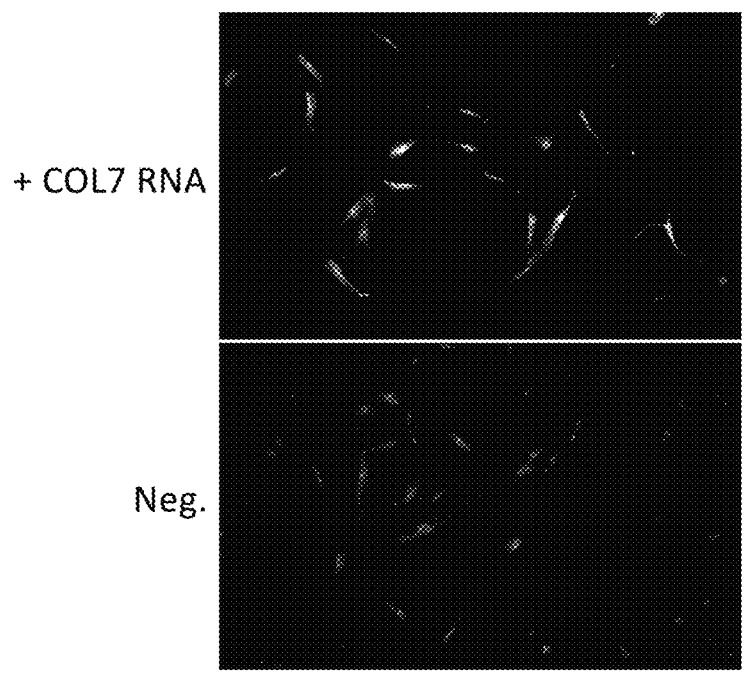

FIG. 18 depicts primary human dermal fibroblasts transfected with synthetic RNA comprising 5-hydroxymethylcytidine and encoding collagen VII (A1) ("+COL7 RNA"). Cells were fixed and stained using an antibody targeting collagen I between 24 and 72 hours after transfection. A representative field is shown for each of: the transfected cells and un-transfected cells ("Neg.").

DETAILED DESCRIPTION OF THE INVENTION

Definitions

By "molecule" is meant a molecular entity (molecule, ion, complex, etc.).

By "RNA molecule" is meant a molecule that comprises RNA.

By "synthetic RNA molecule" is meant an RNA molecule that is produced outside of a cell or that is produced inside of a cell using bioengineering, by way of non-limiting example, an RNA molecule that is produced in an in vitro-transcription reaction, an RNA molecule that is produced by direct chemical synthesis or an RNA molecule that is produced in a genetically-engineered *E. coli* cell.

By "transfection" is meant contacting a cell with a molecule, wherein the molecule is internalized by the cell.

By "upon transfection" is meant during or after transfection.

By "transfection reagent" is meant a substance or mixture of substances that associates with a molecule and facilitates the delivery of the molecule to and/or internalization of the molecule by a cell, by way of non-limiting example, a cationic lipid, a charged polymer or a cell-penetrating peptide.

By "reagent-based transfection" is meant transfection using a transfection reagent.

By "cell-culture medium" is meant a medium that can be used for cell culture, by way of non-limiting example, Dulbecco's Modified Eagle's Medium (DMEM) or DMEM+10% fetal bovine serum (FBS), whether or not the medium is used in vitro or in vivo.

By "complexation medium" is meant a medium to which a transfection reagent and a molecule to be transfected are added and in which the transfection reagent associates with the molecule to be transfected.

By "transfection medium" is meant a medium that can be used for transfection, by way of non-limiting example, Dulbecco's Modified Eagle's Medium (DMEM), DMEM/F12, saline or water, whether or not the medium is used in vitro or in vivo.

By "recombinant protein" is meant a protein or peptide that is not produced in animals or humans. Non-limiting examples include human transferrin that is produced in bacteria, human fibronectin that is produced in an in vitro culture of mouse cells, and human serum albumin that is produced in a rice plant.

By "lipid carrier" is meant a substance that can increase the solubility of a lipid or lipid-soluble molecule in an aqueous solution, by way of non-limiting example, human serum albumin or methyl-beta-cyclodextrin.

By "Oct4 protein" is meant a protein that is encoded by the POU5F1 gene, or a natural or engineered variant, family-member, orthologue, fragment or fusion construct thereof, by way of non-limiting example, human Oct4 protein (SEQ ID NO: 8), mouse Oct4 protein, Oct1 protein, a protein encoded by POU5F1 pseudogene 2, a DNA-binding domain of Oct4 protein or an Oct4-GFP fusion protein. In some embodiments the Oct4 protein comprises an amino acid sequence that has at least 70% identity with SEQ ID NO: 8, or in other embodiments, at least 75%, 80%, 85%, 90%, or 95% identity with SEQ ID NO: 8. In some embodiments, the Oct4 protein comprises an amino acid sequence having from 1 to 20 amino acid insertions, deletions, or substitutions (collectively) with respect to SEQ ID NO: 8. Or in other embodiments, the Oct4 protein comprises an amino acid sequence having from 1 to 15 or from 1 to 10 amino acid insertions, deletions, or substitutions (collectively) with respect to SEQ ID NO: 8.

By "Sox2 protein" is meant a protein that is encoded by the SOX2 gene, or a natural or engineered variant, family-member, orthologue, fragment or fusion construct thereof, by way of non-limiting example, human Sox2 protein (SEQ ID NO: 9), mouse Sox2 protein, a DNA-binding domain of Sox2 protein or a Sox2-GFP fusion protein. In some embodiments the Sox2 protein comprises an amino acid sequence that has at least 70% identity with SEQ ID NO: 9, or in other embodiments, at least 75%, 80%, 85%, 90%, or 95% identity with SEQ ID NO: 9. In some embodiments, the Sox2 protein comprises an amino acid sequence having from 1 to 20 amino acid insertions, deletions, or substitutions (collectively) with respect to SEQ ID NO: 9. Or in other embodiments, the Sox2 protein comprises an amino acid sequence having from 1 to 15 or from 1 to 10 amino acid insertions, deletions, or substitutions (collectively) with respect to SEQ ID NO: 9.

By "Klf4 protein" is meant a protein that is encoded by the KLF4 gene, or a natural or engineered variant, family-member, orthologue, fragment or fusion construct thereof, by way of non-limiting example, human Klf4 protein (SEQ ID NO: 10), mouse Klf4 protein, a DNA-binding domain of Klf4 protein or a Klf4-GFP fusion protein. In some embodiments the Klf4 protein comprises an amino acid sequence that has at least 70% identity with SEQ ID NO: 10, or in other embodiments, at least 75%, 80%, 85%, 90%, or 95% identity with SEQ ID NO: 10. In some embodiments, the Klf4 protein comprises an amino acid sequence having from 1 to 20 amino acid insertions, deletions, or substitutions (collectively) with respect to SEQ ID NO: 10. Or in other embodiments, the Klf4 protein comprises an amino acid sequence having from 1 to 15 or from 1 to 10 amino acid insertions, deletions, or substitutions (collectively) with respect to SEQ ID NO: 10.

By "c-Myc protein" is meant a protein that is encoded by the MYC gene, or a natural or engineered variant, family-member, orthologue, fragment or fusion construct thereof, by way of non-limiting example, human c-Myc protein (SEQ ID NO: 11), mouse c-Myc protein, l-Myc protein, c-Myc (T58A) protein, a DNA-binding domain of c-Myc protein or a c-Myc-GFP fusion protein. In some embodiments the c-Myc protein comprises an amino acid sequence that has at least 70% identity with SEQ ID NO: 11, or in other embodiments, at least 75%, 80%, 85%, 90%, or 95% identity with SEQ ID NO: 11. In some embodiments, the c-Myc protein comprises an amino acid having from 1 to 20 amino acid insertions, deletions, or substitutions (collectively) with respect to SEQ ID NO: 11. Or in other embodiments, the c-Myc protein comprises an amino acid sequence having from 1 to 15 or from 1 to 10 amino acid insertions, deletions, or substitutions (collectively) with respect to SEQ ID NO: 11.

By "reprogramming" is meant causing a change in the phenotype of a cell, by way of non-limiting example, causing a β-cell progenitor to differentiate into a mature β-cell, causing a fibroblast to dedifferentiate into a pluripotent stem cell, causing a keratinocyte to transdifferentiate into a cardiac stem cell, causing the telomeres of a cell to lengthen or causing the axon of a neuron to grow.

By "reprogramming factor" is meant a molecule that, when a cell is contacted with the molecule and/or the cell expresses the molecule, can, either alone or in combination with other molecules, cause reprogramming, by way of non-limiting example, Oct4 protein.

By "feeder" is meant a cell that can be used to condition medium or to otherwise support the growth of other cells in culture.

By "conditioning" is meant contacting one or more feeders with a medium.

By "fatty acid" is meant a molecule that comprises an aliphatic chain of at least two carbon atoms, by way of non-limiting example, linoleic acid, α-linolenic acid, octanoic acid, a leukotriene, a prostaglandin, cholesterol, a glucocorticoid, a resolvin, a protectin, a thromboxane, a lipoxin, a maresin, a sphingolipid, tryptophan, N-acetyl tryptophan or a salt, methyl ester or derivative thereof.

By "short-chain fatty acid" is meant a fatty acid that comprises an aliphatic chain of between two and 30 carbon atoms.

By "albumin" is meant a protein that is highly soluble in water, by way of non-limiting example, human serum albumin.

By "associated molecule" is meant a molecule that is non-covalently bound to another molecule.

By "associated-molecule-component of albumin" is meant one or more molecules that are bound to an albumin polypeptide, by way of non-limiting example, lipids, hormones, cholesterol, calcium ions, etc. that are bound to an albumin polypeptide.

By "treated albumin" is meant albumin that is treated to reduce, remove, replace or otherwise inactivate the associated-molecule-component of the albumin, by way of non-limiting example, human serum albumin that is incubated at an elevated temperature, human serum albumin that is contacted with sodium octanoate or human serum albumin that is contacted with a porous material.

By "ion-exchange resin" is meant a material that, when contacted with a solution containing ions, can replace one or more of the ions with one or more different ions, by way of non-limiting example, a material that can replace one or more calcium ions with one or more sodium ions.

By "germ cell" is meant a sperm cell or an egg cell.

By "pluripotent stem cell" is meant a cell that can differentiate into cells of all three germ layers (endoderm, mesoderm, and ectoderm) in vivo.

By "somatic cell" is meant a cell that is not a pluripotent stem cell or a germ cell, by way of non-limiting example, a skin cell.

By "glucose-responsive insulin-producing cell" is meant a cell that, when exposed to a certain concentration of glucose, can produce and/or secrete an amount of insulin that is different from (either less than or more than) the amount of insulin that the cell produces and/or secretes when the cell is exposed to a different concentration of glucose, by way of non-limiting example, a β-cell.

By "hematopoietic cell" is meant a blood cell or a cell that can differentiate into a blood cell, by way of non-limiting example, a hematopoietic stem cell or a white blood cell.

By "cardiac cell" is meant a heart cell or a cell that can differentiate into a heart cell, by way of non-limiting example, a cardiac stem cell or a cardiomyocyte.

By "retinal cell" is meant a cell of the retina or a cell that can differentiate into a cell of the retina, by way of non-limiting example, a retinal pigmented epithelial cell.

By "skin cell" is meant a cell that is normally found in the skin, by way of non-limiting example, a fibroblast, a keratinocyte, a melanocyte, an adipocyte, a mesenchymal stem cell, an adipose stem cell or a blood cell.

By "Wnt signaling agonist" is meant a molecule that can perform one or more of the biological functions of one or more members of the Wnt family of proteins, by way of non-limiting example, Wnt1, Wnt2, Wnt3, Wnt3a or 2-amino-4-[3,4-(methylenedioxy)benzylamino]-6-(3-methoxyphenyl)pyrimidine.

By "IL-6 signaling agonist" is meant a molecule that can perform one or more of the biological functions of IL-6 protein, by way of non-limiting example, IL-6 protein or IL-6 receptor (also known as soluble IL-6 receptor, IL-6R, IL-6R alpha, etc.).

By "TGF-β signaling agonist" is meant a molecule that can perform one or more of the biological functions of one or more members of the TGF-β superfamily of proteins, by way of non-limiting example, TGF-β1, TGF-β3, Activin A, BMP-4 or Nodal.

By "immunosuppressant" is meant a substance that can suppress one or more aspects of an immune system, and that is not normally present in a mammal, by way of non-limiting example, B18R or dexamethasone.

By "single-strand break" is meant a region of single-stranded or double-stranded DNA in which one or more of the covalent bonds linking the nucleotides has been broken in one of the one or two strands.

By "double-strand break" is meant a region of double-stranded DNA in which one or more of the covalent bonds linking the nucleotides has been broken in each of the two strands.

By "nucleotide" is meant a nucleotide or a fragment or derivative thereof, by way of non-limiting example, a nucleobase, a nucleoside, a nucleotide-triphosphate, etc.

By "nucleoside" is meant a nucleotide or a fragment or derivative thereof, by way of non-limiting example, a nucleobase, a nucleoside, a nucleotide-triphosphate, etc.

By "gene editing" is meant altering the DNA sequence of a cell, by way of non-limiting example, by transfecting the cell with a protein that causes a mutation in the DNA of the cell.

By "gene-editing protein" is meant a protein that can, either alone or in combination with one or more other molecules, alter the DNA sequence of a cell, by way of non-limiting example, a nuclease, a transcription activator-like effector nuclease (TALEN), a zinc-finger nuclease, a meganuclease, a nickase, a clustered regularly interspaced short palindromic repeat (CRISPR)-associated protein or a natural or engineered variant, family-member, orthologue, fragment or fusion construct thereof.

By "repair template" is meant a nucleic acid containing a region of at least about 70% homology with a sequence that is within 10 kb of a target site of a gene-editing protein.

By "repeat sequence" is meant an amino-acid sequence that is present in more than one copy in a protein, to within at least about 10% homology, by way of non-limiting example, a monomer repeat of a transcription activator-like effector.

By "DNA-binding domain" is meant a region of a molecule that is capable of binding to a DNA molecule, by way of non-limiting example, a protein domain comprising one or more zinc fingers, a protein domain comprising one or more transcription activator-like (TAL) effector repeat sequences or a binding pocket of a small molecule that is capable of binding to a DNA molecule.

By "binding site" is meant a nucleic-acid sequence that is capable of being recognized by a gene-editing protein, DNA-binding protein, DNA-binding domain or a biologically active fragment or variant thereof or a nucleic-acid sequence for which a gene-editing protein, DNA-binding protein, DNA-binding domain or a biologically active fragment or variant thereof has high affinity, by way of non-limiting example, an about 20-base-pair sequence of DNA in exon 1 of the human BIRC5 gene.

By "target" is meant a nucleic acid that contains a binding site.

Other definitions are set forth in U.S. application Ser. No. 13/465,490, U.S. Provisional Application No. 61/664,494, U.S. Provisional Application No. 61/721,302, International Application No. PCT/US12/67966, U.S. Provisional Application No. 61/785,404, U.S. Provisional Application No. 61/842,874, International Application No. PCT/US13/68118, U.S. Provisional Application No. 61/934,397, U.S. application Ser. No. 14/296,220, U.S. Provisional Application No. 62/038,608, and U.S. Provisional Application No. 62/069,667, the contents of which are hereby incorporated by reference in their entireties.

Glycation and glycosylation are processes by which one or more sugar molecules are bound to a protein. It has now been discovered that altering the number or location of glycation and glycosylation sites can increase or decrease the stability of a protein. Certain embodiments are therefore directed to a protein with one or more glycation or glycosylation sites. In one embodiment, the protein is engineered to have more glycation or glycosylation sites than a natural variant of the protein. In another embodiment, the protein is engineered to have fewer glycation or glycosylation sites than a natural variant of the protein. In yet another embodiment, the protein has increased stability. In yet another embodiment, the protein has decreased stability.

It has been further discovered that in certain situations, including one or more steroids and/or one or more antioxidants in the transfection medium can increase in vivo transfection efficiency, in vivo reprogramming efficiency, and in vivo gene-editing efficiency. Certain embodiments are therefore directed to contacting a cell or patient with a glucocorticoid, such as hydrocortisone, prednisone, prednisolone, methylprednisolone, dexamethasone or betamethasone. Other embodiments are directed to a method for inducing a cell to express a protein of interest by contacting a cell with a medium containing a steroid and contacting the cell with one or more nucleic acid molecules. In one embodiment, the nucleic acid molecule comprises synthetic RNA. In another embodiment, the steroid is hydrocortisone. In yet another embodiment, the hydrocortisone is present in the medium at a concentration of between about 0.1 uM and about 10 uM, or about 1 uM. Other embodiments are directed to a method for inducing a cell in vivo to express a protein of interest by contacting the cell with a medium containing an antioxidant and contacting the cell with one or more nucleic acid molecules. In one embodiment, the antioxidant is ascorbic acid or ascorbic-acid-2-phosphate. In another embodiment, the ascorbic acid or ascorbic-acid-2-phosphate is present in the medium at a concentration of between about 0.5 mg/L and about 500 mg/L, including about 50 mg/L. Still other embodiments are directed to a method for reprogramming and/or gene-editing a cell in vivo by contacting the cell with a medium containing a steroid and/or an antioxidant and contacting the cell with one or more nucleic acid molecules, wherein the one or more nucleic acid molecules encodes one or more reprogramming and/or gene-editing proteins. In certain embodiments, the cell is present in an organism, and the steroid and/or antioxidant are delivered to the organism.

Adding transferrin to the complexation medium has been reported to increase the efficiency of plasmid transfection in certain situations. It has now been discovered that adding transferrin to the complexation medium can also increase the efficiency of in vivo transfection with synthetic RNA molecules. Certain embodiments are therefore directed to a method for inducing a cell in vivo to express a protein of interest by adding one or more synthetic RNA molecules and a transfection reagent to a solution containing transferrin. In one embodiment, the transferrin is present in the solution at a concentration of between about 1 mg/L and about 100 mg/L, such as about 5 mg/L. In another embodiment, the transferrin is recombinant.

Cells, tissues, organs, and organisms, including, but not limited to, humans, have several characteristics that can inhibit or prevent the delivery of nucleic acids, including, for example, the stratum corneum, which can serve as a barrier to foreign organisms and nucleic acids. These characteristics can thus inhibit the effects of therapeutics and cosmetics comprising nucleic acids. It has now been discovered that many of these characteristics can be circumvented or overcome using a patch comprising a flexible membrane and a plurality of needles, and that such a patch can serve as an effective and safe article for the delivery of nucleic acids. Certain embodiments are therefore directed to a nucleic acid delivery patch. In one embodiment, the nucleic acid delivery patch comprises a flexible membrane. In another embodiment, the nucleic acid delivery patch comprises a plurality of needles. In yet another embodiment, the plurality of needles are attached to the flexible membrane. In some embodiments, the patch comprises a nucleic acid. In one embodiment, the nucleic acid is present in solution. In one embodiment, the plurality of needles include one or more needles having a lumen. In another embodiment, the patch further comprises a second flexible membrane. In yet another embodiment, the flexible membrane and the second flexible membrane are arranged to form a cavity. In a further embodiment, the cavity contains a nucleic acid. In a still further embodiment, the membrane comprises one or more holes through which a nucleic acid can pass. In a still further embodiment, one or more holes and one or more needles having a lumen are arranged to allow the passage of a solution containing a nucleic acid through at least one of the one or more holes and through at least one of the one or more needles having a lumen. In some embodiments, the patch is configured to deliver a solution to the skin. In one embodiment, the solution comprises a nucleic acid. In another embodiment, the solution comprises a vehicle. In yet another embodiment, the vehicle is a lipid or lipidoid. In a still further embodiment, the vehicle is a lipid-based transfection reagent.

The cell membrane can serve as a barrier to foreign nucleic acids. It has now been discovered that combining the patch of the present invention with an electric field can increase the efficiency of nucleic acid delivery. Certain embodiments are therefore directed to a nucleic acid delivery patch comprising a plurality of needles, wherein at least two needles form part of a high-voltage circuit. In one embodiment, the high-voltage circuit generates a voltage greater than about 10V. In another embodiment, the high-voltage circuit generates a voltage greater than about 20V. In yet another embodiment, an electric field is produced between two of the needles. In a further embodiment, the magnitude of the electric field is at least about 100V/cm. In a still further embodiment, the magnitude of the electric field is at least about 200V/cm. In some embodiments, the patch is configured to deliver a nucleic acid to the epidermis. In other embodiments, the patch is configured to deliver a nucleic acid to the dermis. In still other embodiments, the patch is configured to deliver a nucleic acid to sub-dermal tissue. In still other embodiments, the patch is configured to deliver a nucleic acid to muscle. Certain embodiments are directed to a nucleic acid delivery patch comprising a plurality of electrodes. In one embodiment, the plurality of electrodes is attached to a flexible membrane. Other embodiments are directed to a nucleic acid delivery patch comprising a rigid structure. In one embodiment, a plurality of electrodes are attached to the rigid structure.

Other embodiments are directed to a method for delivering a nucleic acid to a cell in vivo comprising applying a nucleic acid to a tissue containing a cell in vivo. In one embodiment, the method further comprises applying a transient electric field in the vicinity of the cell. In another embodiment, the method results in the cell in vivo internalizing the nucleic acid. In yet another embodiment, the nucleic acid comprises synthetic RNA. In a further embodiment, the method further results in the cell internalizing a therapeutically or cosmetically effective amount of the nucleic acid. In one embodiment, the cell is a skin cell. In another embodiment, the cell is a muscle cell. In yet another embodiment, the cell is a dermal fibroblast. In a further embodiment, the cell is a keratinocyte. In a still further embodiment, the cell is a myoblast. In some embodiments, the nucleic acid comprises a protein of interest. In one embodiment, the protein of interest is a fluorescent protein. In another embodiment, the protein of interest is an extracellular-matrix protein. In yet another embodiment, the protein of interest is a member of the group: elastin, collagen, laminin, fibronectin, vitronectin, lysyl oxidase, elastin binding protein, a growth factor, fibroblast growth factor, transforming growth factor beta, granulocyte colony-stimulating factor, a matrix metalloproteinase, an actin, fibrillin, microfibril-associated glycoprotein, a lysyl-oxidase-like protein, platelet-derived growth factor, a lipase, an uncoupling protein, thermogenin, and a protein involved with pigment production. In some embodiments, the method further comprises delivering the nucleic acid to the epidermis. In other embodiments, the method further comprises delivering the nucleic acid to the dermis. In still other embodiments, the method further comprises delivering the nucleic acid below the dermis. In one embodiment, the delivering is by injection. In another embodiment, the delivering is by injection using a micro-needle array. In yet another embodiment, the delivering is by topical administration. In a further embodiment, the delivering comprises disruption or removal of a part of the tissue. In a still further embodiment, the delivering comprises disruption or removal of the stratum corneum. In some embodiments, the nucleic acid is present in solution. In one embodiment, the solution comprises a growth factor. In another embodiment, the growth factor is a member of the group: a fibroblast growth factor and a transforming growth factor. In yet another embodiment, the growth factor is a member of the group: basis fibroblast growth factor and transforming growth factor beta. In other embodiments, the solution comprises cholesterol.

In another embodiment, the method further comprises contacting the cell with one or more nucleic acid molecules. In yet another embodiment, at least one of the one or more nucleic acid molecules encodes a protein of interest. In a further embodiment, the method results in the cell expressing the protein of interest. In a still further embodiment, the method results in the cell expressing a therapeutically or cosmetically effective amount of the protein of interest.

In another embodiment, the cell is contacted with a nucleic acid molecule. In yet another embodiment, the method results in the cell internalizing the nucleic acid molecule. In a further embodiment, the method results in the cell internalizing a therapeutically or cosmetically effective amount of the nucleic acid molecule. In one embodiment, the nucleic acid encodes a protein of interest. In one embodiment, the nucleic acid molecule comprises a member of the group: a dsDNA molecule, a ssDNA molecule, a dsRNA molecule, a ssRNA molecule, a plasmid, an oligonucleotide, a synthetic RNA molecule, a miRNA molecule, an mRNA molecule, and an siRNA molecule.

Synthetic RNA comprising only canonical nucleotides can bind to pattern recognition receptors, can be recognized as a pathogen-associated molecular pattern, and can trigger a potent immune response in cells, which can result in translation block, the secretion of inflammatory cytokines, and cell death. It has now been discovered that synthetic RNA comprising certain non-canonical nucleotides can evade detection by the innate immune system, and can be translated at high efficiency into protein. It has been further discovered that synthetic RNA comprising at least one member of the group: 5-hydroxycytidine, 5-hydroxymethylcytidine, 5-carboxycytidine, 5-formylcytidine, 5-hydroxyuridine, 5-hydroxymethyluridine, 5-carboxyuridine, and 5-formyluridine can evade detection by the innate immune system, and can be translated at high efficiency into protein. Certain embodiments are therefore directed to a method for inducing a cell to express a protein of interest comprising contacting a cell with synthetic RNA. Other embodiments are directed to a method for transfecting a cell with synthetic RNA comprising contacting a cell with a solution comprising one or more synthetic RNA molecules. Still other embodiments are directed to a method for treating a patient comprising administering to the patient synthetic RNA. In one embodiment, the synthetic RNA comprises at least one member of the group: 5-hydroxycytidine, 5-hydroxymethylcytidine, 5-carboxycytidine, 5-formylcytidine, 5-hydroxyuridine, 5-hydroxymethyluridine, 5-carboxyuridine, and 5-formyluridine. In another embodiment, the synthetic RNA encodes a protein of interest. Exemplary RNAs may contain combinations and levels of non-canonical and non-canonical nucleotides as described elsewhere herein, including with respect to the expression of any protein of interest described herein. In yet another embodiment, the method results in the expression of the protein of interest. In a further embodiment, the method results in the expression of the protein of interest in the patient's skin.

It has now been further discovered that contacting a cell with a steroid can suppress the innate immune response to foreign nucleic acids, and can increase the efficiency of nucleic acid delivery and translation. Certain embodiments are therefore directed to contacting a cell with a steroid. Other embodiments are directed to administering a steroid to a patient. In one embodiment, the steroid is hydrocortisone. In another embodiment, the steroid is dexamethasone. Still other embodiments are directed to administering to a patient a member of the group: an antibiotic, an antimycotic, and an RNAse inhibitor.

Other embodiments are directed to a method for delivering a nucleic acid to a cell in vivo. Still other embodiments are directed to a method for inducing a cell in vivo to express a protein of interest. Still other embodiments are directed to a method for treating a patient. In one embodiment, the method comprises disrupting the stratum corneum. In another embodiment, the method comprises contacting a cell with a nucleic acid. In yet another embodiment, the method results in the cell internalizing the nucleic acid. In a further embodiment, the method results in the cell expressing the protein of interest. In a still further embodiment, the method results in the expression of the protein of interest in the patient. In a still further embodiment, the method results in the amelioration of one or more of the patient's symptoms. In a still further embodiment, the patient is in need of the protein of interest. In a still further embodiment, the patient is deficient in the protein of interest.

Still other embodiments are directed to a method for treating a patient comprising delivering to a patient a composition. In one embodiment, the composition comprises albumin that is treated with an ion-exchange resin or charcoal. In another embodiment, the composition comprises one or more nucleic acid molecules. In yet another embodiment, at least one of the one or more nucleic acid molecules encodes a protein of interest. In one embodiment, the method results in the expression of the protein in the patient's skin. In another embodiment, the method results in the expression of a therapeutically or cosmetically effective amount of the protein of interest in the patient. In yet another embodiment, the method comprises administering a steroid. In a further embodiment, the steroid is a member of the group: hydrocortisone and dexamethasone.

Certain embodiments are directed to a synthetic RNA molecule. In one embodiment, the synthetic RNA molecule encodes a protein of interest. In another embodiment, the synthetic RNA molecule comprises a member of the group: 5-hydroxycytidine, 5-hydroxymethylcytidine, 5-carboxycytidine, 5-formylcytidine, 5-hydroxyuridine, 5-hydroxymethyluridine, 5-carboxyuridine, and 5-formyluridine. Other embodiments are directed to a cosmetic composition. In one embodiment, the cosmetic composition comprises albumin. In another embodiment, the albumin is treated with an ion-exchange resin or charcoal. In yet another embodiment, the cosmetic composition comprises a nucleic acid molecule. In a further embodiment, the cosmetic composition comprises both albumin and a nucleic acid molecule. Still other embodiments are directed to a cosmetic treatment article comprising a cosmetic composition contained in a device configured to deliver the composition to a patient. Still other embodiments are directed to a device configured to deliver a cosmetic composition to a patient. In one embodiment, the nucleic acid molecule encodes a member of the group: elastin, collagen, tyrosinase, melanocortin 1 receptor, and hyaluronan synthase.

Certain proteins have long half-lives, and can persist in tissues for several hours, days, weeks, months or years. It has now been discovered that certain methods of treating a patient can result in accumulation of one or more proteins, including, for example, one or more beneficial proteins. Certain embodiments are therefore directed to a method for treating a patient comprising delivering to a patient in a series of doses a nucleic acid encoding one or more proteins. In one embodiment the nucleic acid comprises synthetic RNA. In another embodiment, a first dose is given at a first time-point. In yet another embodiment, a second dose is given at a second time-point. In a further embodiment, the amount of at least one of the one or more proteins in the patient at the second time-point is greater than the amount of said protein at the first time-point. In a still further embodiment, the method results in the accumulation of said protein in the patient.

Other embodiments are directed to a therapeutic composition comprising a nucleic acid molecule encoding one or more proteins, wherein at least one of the one or more proteins is an extracellular matrix protein. Still other embodiments are directed to a cosmetic composition comprising a nucleic acid molecule encoding one or more proteins, wherein at least one of the one or more proteins is an extracellular matrix protein.

Pigmentation disorders can cause severe symptoms in patients. It has now been discovered that pigmentation disorders can be treated by delivering to a patient a nucleic acid encoding tyrosinase. Certain embodiments are therefore directed to a method for treating a pigmentation disorder. Other embodiments are directed to a method for altering the pigmentation of a patient. In one embodiment, the method comprises delivering to a patient a nucleic acid encoding tyrosinase. Other embodiments are directed to a cosmetic composition comprising a nucleic acid encoding tyrosinase. Still other embodiments are directed to a therapeutic composition comprising a nucleic acid encoding tyrosinase. Still other embodiments are directed to a method for increasing the ultraviolet absorption of a patient's skin. In one embodiment the method comprises delivering to a patient a nucleic acid encoding tyrosinase. In another embodiment, the method results in an increase in the ultraviolet absorption of the patient's skin. Still other embodiments are directed to a method for reducing photodamage to a person's skin upon exposure to ultraviolet light. In one embodiment, the method results in the reduction of photodamage to the person's skin upon exposure to ultraviolet light. Still other embodiments are directed to a method for treating xeroderma pigmentosum. In one embodiment, the method comprises delivering to a patient a nucleic acid encoding tyrosinase. Still other embodiments are directed to a method for treating epidermolysis bullosa. In one embodiment, the method comprises delivering to a patient a nucleic acid encoding collagen type VII. In another embodiment, the method comprises delivering to a patient a nucleic acid encoding melanocortin 1 receptor. Still other embodiments are directed to a method for treating xerosis. In one embodiment, the method comprises delivering to a patient a nucleic acid encoding a hyaluronan synthase. In another embodiment, the patient is diagnosed with atopic dermatitis. In yet another embodiment, the patient is diagnosed with ichthyosis. Certain embodiments are directed to a method for treating a cosmetic condition. Other embodiments are directed to a method for inducing tissue healing. In one embodiment, the method comprises delivering to a patient a nucleic acid encoding a hyaluronan synthase. In another embodiment, the cosmetic condition is a member of the group: wrinkles, sagging skin, thin skin, discoloration, and dry skin. In yet another embodiment, the patient has had cataract surgery. In some embodiments, the nucleic acid is synthetic RNA. In other embodiments, the method results in the amelioration of one or more of the patient's symptoms. Other embodiments are directed to a method for treating an indication by delivering to a cell or a patient a nucleic acid encoding a protein or a peptide. Still other embodiments are directed to a composition comprising a nucleic acid encoding a protein or a peptide. Indications that can be treated using the methods and compositions of the present invention and proteins and peptides that can be encoded by compositions of the present invention are set forth in Table 1, and are given by way of example, and not by way of limitation. In one embodiment, the indication is selected from Table 1. In another embodiment the protein or peptide is selected from Table 1. In yet another embodiment, the indication and the protein or peptide are selected from the same row of Table 1. In a further embodiment, the protein of interest is a member of the group: UCP1, UCP2, and UCP3. Other embodiments are directed to methods for inducing a cell to express a plurality of proteins of interest. In one embodiment, the proteins of interest include at least two members of the group: a lipase, UCP1, UCP2, and UCP3. In another embodiment, the proteins of interest include a lipase and a member of the group: UCP1, UCP2, and UCP3. In another embodiment, the protein is a gene-editing protein. In yet another embodiment, the gene-editing protein targets a gene that is at least partly responsible for a disease phenotype. In yet another embodiment, the gene-editing protein targets a gene that encodes a protein selected from Table 1. In still another embodiment, the gene-editing protein corrects or eliminates, either alone or in combination with one or more other molecules or gene-editing proteins, a mutation that is at least partly responsible for a disease phenotype.

TABLE 1

Ilustrative Indications

| Ilustrative Indication | Ilustrative Protein/Peptide |
|---|---|
| Acne | Retinol Dehydrogenase 10 |
| Aging | Elastin |
| Aging | Collagen Type I |
| Aging | Collagen Type III |
| Aging | Collagen Type VII |
| Aging | Hyaluronan Synthase |
| Aging | Telomerase Reverse Transcriptase |
| Albinism | Tyrosinase |
| Alport Syndrome | Collagen Type IV |
| Anemia | Erythropoietin |
| Atopic Dermatitis | Filaggrin |
| Cutis Laxa | Elastin |
| Dystrophic Epidermolysis Bullosa | Collagen Type VII |
| Ehlers-Danlos Syndrome | Collagen Type V |
| Ehlers-Danlos Syndrome | Collagen Type I |
| Epidermolysis bullosa, lethal acantholytic | ADAM17 |
| Epidermolysis bullosa, type IV | Collagen Type III |
| Erythropoietic Protoporphyria | Ferrochelatase |
| Excess Fat | Thermogenin |
| Excess Fat | Lipase |
| Hypotrichosis | ADAM17 |
| Ichthyosis Vulgaris | Filaggrin |
| Infections | Genetic Antibiotics (e.g. Anti-Sigma Factors) |
| Inflammatory and Bullous Skin Bowel Syndrome | Desmoglein 2 |
| Keratosis Pilaris | Retinol Dehydrogenase 10 |
| Oily Skin | Retinol Dehydrogenase 10 |
| Osteoarthritis | Hyaluronan Synthase |
| Pemphigus Vulgaris | Plakophilin-1 |
| Pseudoxanthoma elasticum | Elastin |
| Psoriasis | Retinol Dehydrogenase 10 |
| Scar Treatment | Tyrosinase |
| Scarring | Elastin |
| Scarring | Collagen Type I |
| Scarring | Collagen Type III |
| Skin Cancer | Interferon |
| Striate Palmoplantar Keratoderma | ADAM17 |
| Tanning | Tyrosinase |
| Vitiligo | Melanocyte-Stimulating Hormone |
| Vitiligo | Tyrosinase |
| Warts | Interferon |
| Wound Healing | Elastin |
| Wound Healing | Collagen Type I |
| Wound Healing | Collagen Type III |
| Xeroderma Pigmentosum | DNA Polymerase Eta |

Additional illustrative targets of the present invention include the cosmetic targets listed in Table 6 of International Patent Publication No. WO 2013/151671, the contents of which are hereby incorporated by reference in their entirety.

Further, the present compositions and methods may be used to alter a biological and/or physiological process to, for example, reduce skin sagging, increase skin thickness, increase skin volume, reduce the number of wrinkles, the length of wrinkles and/or the depth of wrinkles, increase skin tightness, firmness, tone and/or elasticity, increase skin hydration and ability to retain moisture, water flow and osmotic balance, increase the levels of skin lipids; increase the extracellular matrix and/or adhesion and communication polypeptides; increase skin energy production; utilization and conservation; improve oxygen utilization; improve skin cell life; improve skin cell immunity defense, heat shock stress response, antioxidant defense capacity to neutralize free radicals, and/or toxic defense; improve the protection and recovery from ultraviolet rays; improve skin cell communication and skin cell innervations; improve cell cohesion/adhesion; improve calcium mineral and other mineral metabolism; improve cell turnover; and improve cell circadian rhythms.

Further still, in some embodiments, the present compositions may be used to treat a disease, disorder and/or condition and/or may alter, modify or change the appearance of a member of the integumentary system of a subject suffering from a disease, disorder and/or condition such as, but not limited to, acne vulgaris, acne aestivalis, acne conglobata, acne cosmetic, acne fulminans, acne keloidalis nuchae, acne mechanica, acne medicamentosa, acne miliaris necrotica, acne necrotica, acne rosacea, actinic keratosis, acne vulgaris, acne aestivalis, acne conglobata, acne cosmetic, acne fulminans, acne keloidalis nuchae, acne mechanica, acne medicamentosa, acne miliaris necrotica, acne necrotica, acne rosacea, acute urticaria, allergic contact dermatitis, alopecia areata, angioedema, athlete's foot, atopic dermatitis, autoeczematization, baby acne, balding, bastomycosis, blackheads, birthmarks and other skin pigmentation problems, boils, bruises, bug bites and stings, burns, cellulitis, chiggers, chloracne, cholinergic or stress uricara, chronic urticaria, cold type urticara, confluent and reticulated papillomatosis, corns, cysts, dandruff, dermatitis herpetiformis, dermatographism, dyshidrotic eczema, diaper rash, dry skin, dyshidrosis, ectodermal dysplasia such as, hyprohidrotic ectodermal dysplasia and X-linked hypohidrotic ectodermal dysplasia, eczema, epidermaodysplasia verruciformis, erythema nodosum, excoriated acne, exercise-induced anaphylasis folliculitis, excess skin oil, folliculitis, freckles, frostbite, fungal nails, hair density, hair growth rate, halogen acne, hair loss, heat rash, hematoma, herpes simplex infections (e.g. non-genital), hidradenitis suppurativa, hives, hyperhidrosis, hyperpigmentation, hypohidrotic ectodermal dysplasia, hypopigmentation, impetigo, ingrown hair, heat type urticaria, ingrown toenail, infantile acne or neonatal acne, itch, irritant contact dermatitis, jock itch, keloid, keratosis pilaris, lichen planus, lichen sclerosus, lupus miliaris disseminatus faciei, melasma, moles, molluscum contagiosum, nail growth rate, nail health, neurodermatitis, nummular eczema, occupational acne, oil acne, onychomycosis, physical urticaria, pilonidal cyst, *pityriasis rosea, pityriasis versicolor*, poison ivy, pomade acne, pseudofolliculitis barbae or acne keloidalis nuchae, psoriasis, psoriatic arthritis, pressure or delayed pressue urticara, puncture wounds such as cuts and scrapes, rash, rare or water type urticaria, rhinoplasty, ringworm, rosacea, rothmund-thomson syndrome, sagging of the skin, scabis, scars, seborrhea, seborrheic dermatitis, shingles, skin cancer, skin tag, solar type urticaria, spider bite, stretch marks, sunburn, tar acne, tropical acne, thinning of skin, thrush, tinea *versicolor*, transient acantholytic dermatosis, tycoon's cap or acne necrotica miliaris, uneven skin tone, varicose veins, venous eczema, vibratory angioedema, vitiligo, warts, Weber-Christian disease, wrinkles, x-linked hypohidrotic ectodermal dysplasia, xerotic eczema, yeast infection and general signs of aging.

In some embodiments, there is provided methods of treating dry skin with the present compositions. In some embodiments profilaggrin (a protein which is converted to filaggrin) is a protein of interest (e.g. when treating ichthyosis vulgaris).

In some embodiments, there is provided methods of treating any one of the various types of psoriasis (e.g. plague psoriasis, guttate psoriasis, pustular psoriasis, inverse psoriasis, and erythrodermic psoriasis). In various embodiments, the protein of interest is any of the products of the genes psoriasis susceptibility 1 through 9 (PSORS1-PSORS9).

Various embodiments relate to the treatment of eczema (e.g. atopic dermatitis, nummular eczema, dyshidrotic eczema, seborrheic dermatitis, irritant contact dermatitis, allergic contact dermatitis, dyshidrosis, venous eczema, dermatitis herpetiformis, neurodermatitis, autoeczematization and xerotic eczema) and, optionally, one or more of the following may be targeted: filaggrin; three genetic variants, ovo-like 1 (OVOL1), actin-like 9 (ACTL9) and kinesin family member 3 A (KIF3A) have been associated with eczema; and the genes brain-derived neurotrophic factor (BDNF) and tachykinin, precursor 1 (TAC1).

Hives, or urticaria, including, but not limited to, acute urticaria, chronic urticara and angioedema, physical urticara, pressure or delayed pressue urticara, cholinergic or stress uricara, cold type urticara, heat type urticara, solar type urticara, rare or water type urticara, vibratory angioedema, exercise-induced anaphylasis and dermatographism may be treated with the present compositions by, for example, targeting PLCG-2.

Various embodiments relate to the treatment of rosacea, which includes, but is not limited to, erthematotelangiectatic rosacea, papulopustular rosacea, phymatous rosacea, and ocular rosacea. Optionally, cathelicidin antimicrobial peptide (CAMP) and/or kallikrein-related peptidase 5 (also known as stratum corneum tryptic enzyme (SCTE)) are proteins of interest.

In some embodiments, there is provided methods of treating acne with the present compositions. For example, acne may include, but is not limited to, acneiform eruptions, acne aestivalis, acne conglobata, acne cosmetic, acne fulminans, acne keloidalis nuchae, acne mechanica, acne medicamentosa, acne miliaris necrotica, acne necrotica, acne rosacea, baby acne, blackheads, chloracne, excoriated acne, halogen acne, infantile acne or neonatal acne, lupus miliaris disseminatus faciei, occupational acne, oil acne, pomade acne, tar acne, tropical acne, tycoon's cap or acne necrotica miliaris, pseudofolliculitis barbae or acne keloidalis nuchae, and hidradenitis suppurativa. In these embodiments, the protein of interest may be one or more matrix metalloproteinases (MMP), e.g., matrix metalloproteinase-1 (MMP-1 or interstitial collagenase), matrix metalloproteinase-9 (MMP-9), and matrix metalloproteinase-13 (MMP-13).

In further embodiments, vitiligo is treated with the present compositions, e.g. wherein the NLR family, pyrin domain containing 1 gene (NALP1) gene is targeted.

In some embodiments, the present compositions find use in the treatment of hyprohidrotic ectodermal dysplasia (HED), e.g. via the ectodysplasin A gene (EDA), receptor (EDAR), and receptor associated death domain (EDARADD).

In some embodiments, the present compositions find use in the treatment of balding, or hair thinning (e.g. male pattern baldness, or androgenetic alopecia (AGA)) and, optionally, one or more of the following may be the protein of interest: androgen receptor (AR), ectodysplasin A2 receptor (EDA2R) and lysophosphatidic acid receptor 6 (P2RY5).

The present compositions also find use in methods of treating scars and stretch marks (striae), e.g. via collagen, ribosomal s6 kinase, sectrected phosphoprotein 1 (also known as osteopontin), or transforming growth factor beta 3.

Epidermodysplasia verruciformis (also known as Lutz-Lewandowsky epidermodysplasia), a rare autosomal recessive genetic hereditary skin disorder, may also be treated with compositions of the present invention, e.g. by targetted transmembrane channel-like 6 (EVER1) or transmembrane channellike 8 (EVER2) genes.

In some embodiments, skin sagging, thinning or wrinkling may be treated with present composition, e.g. by targeting one or more of the proteins of interest such as collagen, elastin, fibroblast growth factor 7, TIMP metallopeptidase inhibitors, matrix metallopeptidases, superoxide dismutase and other extracellular matrix proteins and proteoglycans.

Further embodiments are used in tanning of the skin, such as via melanocyte-stimulating hormone and/or pro-opiomelanocortin.

In some embodiments, the present compositions may be used for wound treatment. In some embodiments, methods of treating wounds with the present compositions comprises additional steps of, for example, cleaning the wound bed to facilitate wound healing and closure, including, but not limited to: debridement, sharp debridement (surgical removal of dead or infected tissue from a wound), optionally including chemical debriding agents, such as enzymes, to remove necrotic tissue; wound dressings to provide the wound with a moist, warm environment and to promote tissue repair and healing (e.g., wound dressings comprising hydrogels (e.g., AQUASORB®; DUODERM®), hydrocolloids (e.g., AQUACEL®; COMFEEL®), foams (e.g., LYOFOAM®; SPYROSORB®), and alginates (e.g., ALGISITE®; CURASORB®); administration of growth factors to stimulate cell division and proliferation and to promote wound healing e.g. becaplermin; and (iv) soft-tissue wound coverage, a skin graft may be necessary to obtain coverage of clean, non-healing wounds (e.g., autologous skin grafts, cadaveric skin graft, bioengineered skin substitutes (e.g., APLIGRAF®; DERMAGRAFT®)).

In various embodiments, a variety of cancers are treated with the present compositions (e.g., colorectal cancer, gallbladder cancer, lung cancer, pancreatic cancer, and stomach cancer). In some embodiments, skin cancer is treated with the present compositions. For instance, basal cell cancer (BCC), squamous cell cancer (SCC), and melanoma. In some embodiments, the present compositions are used adjuvant to complete circumferential peripheral and deep margin assessment, Mohs surgery, radiation (e.g. external beam radiotherapy or brachytherapy), chemotherapy (including but not limited to topical chemotherapy, e.g. with imiquimod or 5-fluorouracil), and cryotherapy. The present compositions also find use in the treatment of various stages of cancers, including skin cancers (e.g. basal cell cancer (BCC), squamous cell cancer (SCC), and melanoma), such as a stage of the American Joint Committee on Cancer (AJCC) TNM system (e.g. one or more of TX, T0, Tis, T1, T1a, T1b, T2, T2A, T2B, T3, T3a, T3b, T4, T4a, T4b, NX, N0, N1, N2, N3, M0, M1a, M1b, M1c) and/or a staging system (e.g. Stage 0, Stage IA, Stage IB, Stage IIA, Stage IIB, Stage IIC, Stage IIIA, Stage IIIB, Stage IIIC, Stage IV).

In various embodiments, one or more rare diseases are treated with the present compositions, including, by way of illustration, Erythropoietic Protoporphyria, Hailey-Hailey Disease, Epidermolysis Bullosa (EB), Xeroderma Pigmentosum, Ehlers-Danlos Syndrome, Cutis *Laxa*, Protein C & Protein S Deficiency, Alport Syndrome, Striate Palmoplantar Keratoderma, Lethal Acantholytic EB, Pseudoxanthoma Elasticum (PXE), Ichthyosis Vulgaris, Pemphigus Vulgaris, and Basal Cell Nevus Syndrome.

In certain situations, it may be desirable to replace animal-derived components with non-animal-derived and/or recombinant components, in part because non-animal-derived and/or recombinant components can be produced with a higher degree of consistency than animal-derived components, and in part because non-animal-derived and/or recombinant components carry less risk of contamination with toxic and/or pathogenic substances than do animal-derived components. Certain embodiments are therefore directed to a protein that is non-animal-derived and/or recombinant. Other embodiments are directed to a medium, wherein some or all of the components of the medium are non-animal-derived and/or recombinant.

Other embodiments are directed to a method for transfecting a cell in vivo. In one embodiment, a cell in vivo is transfected with one or more nucleic acids, and the transfection is performed using a transfection reagent, such as a lipid-based transfection reagent. In one embodiment, the one or more nucleic acids includes at least one RNA molecule. In another embodiment, the cell is transfected with one or more nucleic acids, and the one or more nucleic acids encodes at least one of: p53, TERT, a cytokine, a secreted protein, a membrane-bound protein, an enzyme, a gene-editing protein, a chromatin-modifying protein, a DNA-binding protein, a transcription factor, a histone deacetylase, a pathogen-associated molecular pattern, and a tumor-associated antigen or a biologically active fragment, analogue, variant or family-member thereof. In another embodiment, the cell is transfected repeatedly, such as at least about 2 times during about 10 consecutive days, or at least about 3 times during about 7 consecutive days, or at least about 4 times during about 6 consecutive days.

Reprogramming can be performed by transfecting cells with one or more nucleic acids encoding one or more reprogramming factors. Examples of reprogramming factors include, but are not limited to: Oct4 protein, Sox2 protein, Klf4 protein, c-Myc protein, l-Myc protein, TERT protein, Nanog protein, Lin28 protein, Utf1 protein, Aicda protein, miR200 micro-RNA, miR302 micro-RNA, miR367 micro-RNA, miR369 micro-RNA and biologically active fragments, analogues, variants and family-members thereof. Certain embodiments are therefore directed to a method for reprogramming a cell in vivo. In one embodiment, the cell in vivo is reprogrammed by transfecting the cell with one or more nucleic acids encoding one or more reprogramming factors. In one embodiment, the one or more nucleic acids includes an RNA molecule that encodes Oct4 protein. In another embodiment, the one or more nucleic acids also includes one or more RNA molecules that encodes Sox2 protein, Klf4 protein, and c-Myc protein. In yet another embodiment, the one or more nucleic acids also includes an RNA molecule that encodes Lin28 protein. In one embodiment, the cell is a human skin cell, and the human skin cell is reprogrammed to a pluripotent stem cell. In another embodiment, the cell is a human skin cell, and the human skin cell is reprogrammed to a glucose-responsive insulin-producing cell. Examples of other cells that can be reprogrammed and other cells to which a cell can be reprogrammed include, but are not limited to: skin cells, pluripotent stem cells, mesenchymal stem cells, 8-cells, retinal pigmented epithelial cells, hematopoietic cells, cardiac cells, airway epithelial cells, neural stem cells, neurons, glial cells, bone cells, blood cells, and dental pulp stem cells. In one embodiment, the cell is contacted with a medium that supports the reprogrammed cell. In one embodiment, the medium also supports the cell.

Importantly, infecting skin cells with viruses encoding Oct4, Sox2, Klf4, and c-Myc, combined with culturing the cells in a medium that supports the growth of cardiomyocytes, has been reported to cause reprogramming of the skin cells to cardiomyocytes, without first reprogramming the skin cells to pluripotent stem cells (See Efs et al Nat Cell Biol. 2011; 13:215-22, the contents of which are hereby incorporated by reference). In certain situations, direct reprogramming (reprogramming one somatic cell to another somatic cell without first reprogramming the somatic cell to a pluripotent stem cell, also known as "transdifferentiation") may be desirable, in part because culturing pluripotent stem cells can be time-consuming and expensive, the additional handling involved in establishing and characterizing a stable pluripotent stem cell line can carry an increased risk of contamination, and the additional time in culture associated with first producing pluripotent stem cells can carry an increased risk of genomic instability and the acquisition of mutations, including point mutations, copy-number variations, and karyotypic abnormalities. Certain embodiments are therefore directed to a method for reprogramming a somatic cell in vivo, wherein the cell is reprogrammed to a somatic cell, and wherein a characterized pluripotent stem-cell line is not produced.

It has been further discovered that, in certain situations, fewer total transfections may be required to reprogram a cell according to the methods of the present invention than according to other methods. Certain embodiments are therefore directed to a method for reprogramming a cell in vivo, wherein between about 1 and about 12 transfections are performed during about 20 consecutive days, or between about 4 and about 10 transfections are performed during about 15 consecutive days, or between about 4 and about 8 transfections are performed during about 10 consecutive days. It is recognized that when a cell is contacted with a medium containing nucleic acid molecules, the cell may likely come into contact with and/or internalize more than one nucleic acid molecule either simultaneously or at different times. A cell can therefore be contacted with a nucleic acid more than once, e.g. repeatedly, even when a cell is contacted only once with a medium containing nucleic acids.

Of note, nucleic acids can contain one or more non-canonical, or "modified", residues (e.g. a residue other than adenine, guanine, thymine, uracil, and cytosine or the standard nucleoside, nucleotide, deoxynucleoside or deoxynucleotide derivatives thereof). Of particular note, pseudouridine-5-triphosphate can be substituted for uridine-5-triphosphate in an in vitro-transcription reaction to yield synthetic RNA, wherein up to 100% of the uridine residues of the synthetic RNA may be replaced with pseudouridine residues. In vitro-transcription can yield RNA with residual immunogenicity, even when pseudouridine and 5-methylcytidine are completely substituted for uridine and cytidine, respectively (See, e.g., Angel. Reprogramming Human Somatic Cells to Pluripotency Using RNA [Doctoral Thesis]. Cambridge, Mass.: MIT; 2011, the contents of which are hereby incorporated by reference). For this reason, it is common to add an immunosuppressant to the transfection medium when transfecting cells with RNA. In certain situations, adding an immunosuppressant to the transfection medium may not be desirable, in part because the recombinant immunosuppressant most commonly used for this purpose, B18R, can be expensive and difficult to manufacture. It has now been discovered that cells in vivo can be transfected and/or reprogrammed according to the methods of the present invention, without using B18R or any other immunosuppressant. It has been further discovered that reprogramming cells in vivo according to the methods of the present invention without using immunosuppressants can be rapid, efficient, and reliable. Certain embodiments are therefore directed to a method for transfecting a cell in vivo, wherein the transfection medium does not contain an immunosuppressant. Other embodiments are directed to a method for reprogramming a cell in vivo, wherein the transfection medium does not contain an immunosuppressant. In certain situations, for example when using a high cell density, it may be beneficial to add an immunosuppressant to the transfection medium. Certain embodiments are therefore directed to a method for transfecting a cell in vivo, wherein the transfection medium contains an immunosuppressant. Other embodiments are directed to a method for reprogramming a cell in vivo, wherein the transfection medium contains an immunosuppressant. In one embodiment, the immunosuppressant is B18R or a biologically active fragment, analogue, variant or family-member thereof or dexamethasone or a derivative thereof. In one embodiment, the transfection medium does not contain an immunosuppressant, and the nucleic-acid dose is chosen to prevent excessive toxicity. In another embodiment, the nucleic-acid dose is less than about 1 mg/cm$^2$ of tissue or less than about 1 mg/100,000 cells or less than about 10 mg/kg.

Reprogrammed cells produced according to certain embodiments of the present invention are suitable for therapeutic and/or cosmetic applications as they do not contain exogenous DNA sequences, and they are not exposed to animal-derived or human-derived products, which may be undefined, and which may contain toxic and/or pathogenic contaminants. Furthermore, the high speed, efficiency, and reliability of certain embodiments of the present invention may reduce the risk of acquisition and accumulation of mutations and other chromosomal abnormalities. Certain embodiments of the present invention can thus be used to generate cells that have a safety profile adequate for use in therapeutic and/or cosmetic applications. For example, reprogramming cells using RNA and the medium of the present invention, wherein the medium does not contain animal or human-derived components, can yield cells that have not been exposed to allogeneic material. Certain embodiments are therefore directed to a reprogrammed cell that has a desirable safety profile. In one embodiment, the reprogrammed cell has a normal karyotype. In another embodiment, the reprogrammed cell has fewer than about 5 copy-number variations (CNVs) relative to the patient genome, such as fewer than about 3 copy-number variations relative to the patient genome, or no copy-number variations relative to the patient genome. In yet another embodiment, the reprogrammed cell has a normal karyotype and fewer than about 100 single nucleotide variants in coding regions relative to the patient genome, or fewer than about 50 single nucleotide variants in coding regions relative to the patient genome, or fewer than about 10 single nucleotide variants in coding regions relative to the patient genome.

Endotoxins and nucleases can co-purify and/or become associated with other proteins, such as serum albumin. Recombinant proteins, in particular, can often have high levels of associated endotoxins and nucleases, due in part to the lysis of cells that can take place during their production. Endotoxins and nucleases can be reduced, removed, replaced or otherwise inactivated by many of the methods of the present invention, including, for example, by acetylation, by addition of a stabilizer such as sodium octanoate, followed by heat treatment, by the addition of nuclease inhibitors to the albumin solution and/or medium, by crystallization, by contacting with one or more ion-exchange resins, by contacting with charcoal, by preparative electrophoresis or by affinity chromatography. It has now been discovered that partially or completely reducing, removing, replacing or otherwise inactivating endotoxins and/or nucleases from a medium and/or from one or more components of a medium can increase the efficiency with which cells can be transfected and reprogrammed. Certain embodiments are therefore directed to a method for transfecting a cell in vivo with one or more nucleic acids, wherein the transfection medium is treated to partially or completely reduce, remove, replace or otherwise inactivate one or more endotoxins and/or nucleases. Other embodiments are directed to a medium that causes minimal degradation of nucleic acids. In one embodiment, the medium contains less than about 1 EU/mL, or less than about 0.1 EU/mL, or less than about 0.01 EU/mL.

In certain situations, protein-based lipid carriers such as serum albumin can be replaced with non-protein-based lipid carriers such as methyl-beta-cyclodextrin. The medium of the present invention can also be used without a lipid carrier, for example, when transfection is performed using a method that may not require or may not benefit from the presence of a lipid carrier, for example, using one or more lipid-based transfection reagents, polymer-based transfection reagents or peptide-based transfection reagents or using electroporation. Many protein-associated molecules, such as metals, can be highly toxic to cells in vivo. This toxicity can cause decreased viability, as well as the acquisition of mutations. Certain embodiments thus have the additional benefit of producing cells that are free from toxic molecules.

The associated-molecule component of a protein can be measured by suspending the protein in solution and measuring the conductivity of the solution. Certain embodiments are therefore directed to a medium that contains a protein, wherein about a 10% solution of the protein in water has a conductivity of less than about 500 μmho/cm. In one embodiment, the solution has a conductivity of less than about 50 μmho/cm. In another embodiment, less than about 0.65% of the dry weight of the protein comprises lipids and/or less than about 0.35% of the dry weight of the protein comprises free fatty acids.

The amount of nucleic acid delivered to cells in vivo can be increased to increase the desired effect of the nucleic acid. However, increasing the amount of nucleic acid delivered to cells in vivo beyond a certain point can cause a decrease in the viability of the cells, due in part to toxicity of the transfection reagent. It has now been discovered that when a nucleic acid is delivered to a population of cells in vivo in a fixed volume (for example, cells in a region of tissue), the amount of nucleic acid delivered to each cell can depend on the total amount of nucleic acid delivered to the population of cells and to the density of the cells, with a higher cell density resulting in less nucleic acid being delivered to each cell. In certain embodiments, a cell in vivo is transfected with one or more nucleic acids more than once. Under certain conditions, for example when the cells are proliferating, the cell density may change from one transfection to the next. Certain embodiments are therefore directed to a method for transfecting a cell in vivo with a nucleic acid, wherein the cell is transfected more than once, and wherein the amount of nucleic acid delivered to the cell is different for two of the transfections. In one embodiment, the cell proliferates between two of the transfections, and the amount of nucleic acid delivered to the cell is greater for the second of the two transfections than for the first of the two transfections. In another embodiment, the cell is transfected more than twice, and the amount of nucleic acid delivered to the cell is greater for the second of three transfections than for the first of the same three transfections, and the amount of nucleic acid delivered to the cells is greater for the third of the same three transfections than for the second of the same three transfections. In yet another embodiment, the cell is transfected more than once, and the maximum amount of nucleic acid delivered to the cell during each transfection is sufficiently low to yield at least about 80% viability for at least two consecutive transfections.

It has now been discovered that modulating the amount of nucleic acid delivered to a population of proliferating cells in vivo in a series of transfections can result in both an increased effect of the nucleic acid and increased viability of the cells. It has been further discovered that, in certain situations, when cells in vivo are contacted with one or more nucleic acids encoding one or more reprogramming factors in a series of transfections, the efficiency of reprogramming can be increased when the amount of nucleic acid delivered in later transfections is greater than the amount of nucleic acid delivered in earlier transfections, for at least part of the series of transfections. Certain embodiments are therefore directed to a method for reprogramming a cell in vivo, wherein one or more nucleic acids is repeatedly delivered to the cell in a series of transfections, and the amount of the nucleic acid delivered to the cell is greater for at least one later transfection than for at least one earlier transfection. In one embodiment, the cell is transfected between about 2 and about 10 times, or between about 3 and about 8 times, or between about 4 and about 6 times. In another embodiment, the one or more nucleic acids includes at least one RNA molecule, the cell is transfected between about 2 and about 10 times, and the amount of nucleic acid delivered to the cell in each transfection is the same as or greater than the amount of nucleic acid delivered to the cell in the most recent previous transfection. In yet another embodiment, the amount of nucleic acid delivered to the cell in the first transfection is between about 20 ng/cm$^2$ and about 250 ng/cm$^2$, or between 100 ng/cm$^2$ and 600 ng/cm$^2$. In yet another embodiment, the cell is transfected about 5 times at intervals of between about 12 and about 48 hours, and the amount of nucleic acid delivered to the cell is about 25 ng/cm$^2$ for the first transfection, about 50 ng/cm$^2$ for the second transfection, about 100 ng/cm$^2$ for the third transfection, about 200 ng/cm$^2$ for the fourth transfection, and about 400 ng/cm$^2$ for the fifth transfection. In yet another embodiment, the cell is further transfected at least once after the fifth transfection, and the amount of nucleic acid delivered to the cell is about 400 ng/cm$^2$.

Certain embodiments are directed to a method for transfecting a cell in vivo with a nucleic acid, wherein the amount of nucleic acid is determined by measuring the cell density, and choosing the amount of nucleic acid to transfect based on the measurement of cell density. In one embodiment, the cell density is measured by optical means. In another embodiment, the cell is transfected repeatedly, the cell density increases between two transfections, and the amount of nucleic acid transfected is greater for the second of the two transfections than for the first of the two transfections.

It has now been discovered that, in certain situations, the in vivo transfection efficiency and viability of cells contacted with the medium of the present invention can be improved by conditioning the medium. Certain embodiments are therefore directed to a method for conditioning a medium. Other embodiments are directed to a medium that is conditioned. In one embodiment, the feeders are fibroblasts, and the medium is conditioned for approximately 24 hours. Other embodiments are directed to a method for transfecting a cell in vivo, wherein the transfection medium is conditioned. Other embodiments are directed to a method for reprogramming and/or gene-editing a cell in vivo, wherein the medium is conditioned. In one embodiment, the feeders are mitotically inactivated, for example, by exposure to a chemical such as mitomycin-C or by exposure to gamma radiation. In certain embodiments, it may be beneficial to use only autologous materials, in part to, for example and not wishing to be bound by theory, avoid the risk of disease transmission from the feeders to the cell or the patient. Certain embodiments are therefore directed to a method for transfecting a cell in vivo, wherein the transfection medium is conditioned, and wherein the feeders are derived from the same individual as the cell being transfected. Other embodiments are directed to a method for reprogramming and/or gene-editing a cell in vivo, wherein the medium is conditioned, and wherein the feeders are derived from the same individual as the cell being reprogrammed and/or gene-edited.

Several molecules can be added to media by conditioning. Certain embodiments are therefore directed to a medium that is supplemented with one or more molecules that are present in a conditioned medium. In one embodiment, the medium is supplemented with Wnt1, Wnt2, Wnt3, Wnt3a or a biologically active fragment, analogue, variant, agonist, or family-member thereof. In another embodiment, the medium is supplemented with TGF-β or a biologically active fragment, analogue, variant, agonist, or family-member thereof. In yet another embodiment, a cell in vivo is reprogrammed according to the method of the present invention, wherein the medium is not supplemented with TGF-β for between about 1 and about 5 days, and is then supplemented with TGF-β for at least about 2 days. In yet another embodiment, the medium is supplemented with IL-6, IL-6R or a biologically active fragment, analogue, variant, agonist, or family-member thereof. In yet another embodiment, the medium is supplemented with a sphingolipid or a fatty acid. In still another embodiment, the sphingolipid is lysophosphatidic acid, lysosphingomyelin, sphingosine-1-phosphate or a biologically active analogue, variant or derivative thereof.

In addition to mitotically inactivating cells, under certain conditions, irradiation can change the gene expression of cells, causing cells to produce less of certain proteins and more of certain other proteins that non-irradiated cells, for example, members of the Wnt family of proteins. In addition, certain members of the Wnt family of proteins can promote the growth and transformation of cells. It has now been discovered that, in certain situations, the efficiency of reprogramming can be greatly increased by contacting a cell in vivo with a medium that is conditioned using irradiated feeders instead of mitomycin-c-treated feeders. It has been further discovered that the increase in reprogramming efficiency observed when using irradiated feeders is caused in part by Wnt proteins that are secreted by the feeders. Certain embodiments are therefore directed to a method for reprogramming a cell in vivo, wherein the cell is contacted with Wnt1, Wnt2, Wnt3, Wnt3a or a biologically active fragment, analogue, variant, family-member or agonist thereof, including agonists of downstream targets of Wnt proteins, and/or agents that mimic one or more of the biological effects of Wnt proteins, for example, 2-amino-4-[3,4-(methylenedioxy)benzylamino]-6-(3-methoxyphenyl)pyrimidine.

Because of the low efficiency of many DNA-based reprogramming methods, these methods may be difficult or impossible to use with cells derived from patient samples, which may contain only a small number of cells. In contrast, the high efficiency of certain embodiments of the present invention can allow reliable reprogramming of a small number of cells, including single cells. Certain embodiments are directed to a method for reprogramming a small number of cells. Other embodiments are directed to a method for reprogramming a single cell. In one embodiment, the cell is contacted with one or more enzymes. In another embodiment, the enzyme is collagenase. In yet another embodiment, the collagenase is animal-component free. In one embodiment, the collagenase is present at a concentration of between about 0.1 mg/mL and about 10 mg/mL, or between about 0.5 mg/mL and about 5 mg/mL. In another embodiment, the cell is a blood cell. In yet another embodiment, the cell is contacted with a medium containing one or more proteins that is derived from the patient's blood. In still another embodiment, the cell is contacted with a medium comprising: DMEM/F12+2 mM L-alanyl-L-glutamine+between about 5% and about 25% patient-derived serum, or between about 10% and about 20% patient-derived serum, or about 20% patient-derived serum.

It has now been discovered that, in certain situations, transfecting cells in vivo with a mixture of RNA encoding Oct4, Sox2, Klf4, and c-Myc using the medium of the present invention can cause the rate of proliferation of the cells to increase. When the amount of RNA delivered to the cells is too low to ensure that all of the cells are transfected, only a fraction of the cells may show an increased proliferation rate. In certain situations, such as when generating a personalized therapeutic, increasing the proliferation rate of cells may be desirable, in part because doing so can reduce the time necessary to generate the therapeutic, and therefore can reduce the cost of the therapeutic. Certain embodiments are therefore directed to a method for transfecting a cell in vivo with a mixture of RNA encoding Oct4, Sox2, Klf4, and c-Myc. In one embodiment, the cell exhibits an increased proliferation rate. In another embodiment, the cell is reprogrammed.

Many diseases are associated with one or more mutations. Mutations can be corrected by contacting a cell with a nucleic acid that encodes a protein that, either alone or in combination with other molecules, corrects the mutation (an example of gene-editing). Examples of such proteins include: zinc finger nucleases and TALENs. Certain embodiments are therefore directed to a method for transfecting a cell in vivo with a nucleic acid, wherein the nucleic acid encodes a protein that, either alone or in combination with other molecules, creates a single-strand or double-strand break in a DNA molecule. In a one embodiment, the protein is a zinc finger nuclease or a TALEN. In another embodiment, the nucleic acid is an RNA molecule. In yet another embodiment, the single-strand or double-strand break is within about 5,000,000 bases of the transcription start site of a gene selected from the group: CCR5, CXCR4, GAD1, GAD2, CFTR, HBA1, HBA2, HBB, HBD, FANCA, XPA, XPB, XPC, ERCC2, POLH, HTT, DMD, SOD1, APOE, PRNP, BRCA1, and BRCA2 or an analogue, variant or family-member thereof. In yet another embodiment, the cell is transfected with a nucleic acid that acts as a repair template by either causing the insertion of a DNA sequence in the region of the single-strand or double-strand break or by causing the DNA sequence in the region of the single-strand or double-strand break to otherwise change. In yet another embodiment, the cell is reprogrammed, and subsequently, the cell is gene-edited. In yet another embodiment, the cell is gene-edited, and subsequently, the cell is reprogrammed. In yet another embodiment, the gene-editing and reprogramming are performed within about 7 days of each other. In yet another embodiment, the gene-editing and reprogramming occur simultaneously or on the same day. In yet another embodiment, the cell is a skin cell, the skin cell is gene-edited to disrupt the CCR5 gene, the skin cell is reprogrammed to a hematopoietic stem cell, thus producing a therapeutic for HIV/AIDS, and the therapeutic is used to treat a patient with HIV/AIDS. In yet another embodiment, the skin cell is derived from the same patient whom the therapeutic is used to treat.

Genes that can be edited according to the methods of the present invention to produce therapeutics of the present invention include genes that can be edited to restore normal function, as well as genes that can be edited to reduce or eliminate function. Such genes include, but are not limited to beta globin (HBB), mutations in which can cause sickle cell disease (SCD) and β-thalassemia, breast cancer 1, early onset (BRCA1) and breast cancer 2, early onset (BRCA2), mutations in which can increase susceptibility to breast cancer, C—C chemokine receptor type 5 (CCR5) and C—X—C chemokine receptor type 4 (CXCR4), mutations in which can confer resistance to HIV infection, cystic fibrosis transmembrane conductance regulator (CFTR), mutations in which can cause cystic fibrosis, dystrophin (DMD), mutations in which can cause muscular dystrophy, including Duchenne muscular dystrophy and Becker's muscular dystrophy, glutamate decarboxylase 1 and glutamate decarboxylase 2 (GAD1, GAD2), mutations in which can prevent autoimmune destruction of β-cells, hemoglobin alpha 1, hemoglobin alpha 2, and hemoglobin delta (HBA1, HBA2, and HBD), mutations in which can cause thalassemia, Huntington (HTT), mutations in which can cause Huntington's disease, superoxide dismutase 1 (SOD1), mutations in which can cause amyotrophic lateral sclerosis (ALS), XPA, XPB, XPC, XPD (ERCC6) and polymerase (DNA directed), eta (POLH), mutations in which can cause xeroderma pigmentosum, leucine-rich repeat kinase 2 (LRRK2), mutations in which can cause Parkinson's disease, and Fanconi anemia, complementation groups A, B, C, D1, D2, E, F, G, I, J, L, M, N, P (FANCA, FANCB, FANCC, FANCD1, FANCD2, FANCE, FANCF, FANCG, FANCI, FANCJ, FANCL, FANCM, FANCN, FANCP), and RAD51 homolog C (*S. cerevisiae*) (RAD51C), mutations in which can cause Fanconi anemia.

Certain embodiments are directed to a therapeutic comprising a nucleic acid. In one embodiment, the nucleic acid encodes one or more gene-editing proteins. Other embodiments are directed to a therapeutic comprising one or more cells that are transfected, reprogrammed, and/or gene-edited in vivo according to the methods of the present invention. In one embodiment, a cell is transfected, reprogrammed, and/or gene-edited, and the transfected, reprogrammed, and/or gene-edited cell is introduced into a patient. In another embodiment, the cell is harvested from the same patient into whom the transfected, reprogrammed and/or gene-edited cell is introduced. Examples of diseases that can be treated with therapeutics of the present invention include, but are not limited to Alzheimer's disease, spinal cord injury, amyotrophic lateral sclerosis, cystic fibrosis, heart disease, including ischemic and dilated cardiomyopathy, macular degeneration, Parkinson's disease, Huntington's disease, diabetes, sickle-cell anemia, thalassemia, Fanconi anemia, xeroderma pigmentosum, muscular dystrophy, severe combined immunodeficiency, hereditary sensory neuropathy, cancer, and HIV/AIDS. In certain embodiments, the therapeutic comprises a cosmetic. In one embodiment, a cell is harvested from a patient, the cell is reprogrammed and expanded to a large number of adipose cells to produce a cosmetic, and the cosmetic is introduced into the patient. In still another embodiment, the cosmetic is used for tissue reconstruction.

While detailed examples are provided herein for the production of specific types of cells and for the production of therapeutics comprising specific types of cells, it is recognized that the methods of the present invention can be used to produce many other types of cells, and to produce therapeutics comprising one or more of many other types of cells, for example, by reprogramming a cell according to the methods of the present invention, and culturing the cell under conditions that mimic one or more aspects of development by providing conditions that resemble the conditions present in the cellular microenvironment during development.

Certain embodiments are directed to a library of cells with a variety of human leukocyte antigen (HLA) types ("HLA-matched libraries"). An HLA-matched library may be beneficial in part because it can provide for the rapid production and/or distribution of therapeutics without the patient having to wait for a therapeutic to be produced from the patient's cells. Such a library may be particularly beneficial for the production of cosmetics and for the treatment of heart disease and diseases of the blood and/or immune system for which patients may benefit from the immediate availability of a therapeutic or cosmetic.

Certain non-canonical nucleotides, when incorporated into synthetic RNA molecules, can reduce the toxicity of the synthetic RNA molecules, in part by interfering with binding of proteins that detect exogenous nucleic acids, for example, protein kinase R, Rig-1 and the oligoadenylate synthetase family of proteins. Non-canonical nucleotides that have been reported to reduce the toxicity of synthetic RNA molecules when incorporated therein include: pseudouridine, 5-methyluridine, 2-thiouridine, 5-methylcytidine, N6-methyladenosine, and certain combinations thereof. However, the chemical characteristics of non-canonical nucleotides that can enable them to lower the in vivo toxicity of synthetic RNA molecules have, until this point, remained unknown. Furthermore, incorporation of large amounts of most non-canonical nucleotides, for example, 5-methyluridine, 2-thiouridine, 5-methylcytidine, and N6-methyladenosine, can reduce the efficiency with which synthetic RNA molecules can be translated into protein, limiting the utility of synthetic RNA molecules containing these nucleotides in applications that require protein expression. In addition, while pseudouridine can be completely substituted for uridine in synthetic RNA molecules without reducing the efficiency with which the synthetic RNA molecules can be translated into protein, in certain situations, for example, when performing frequent, repeated transfections, synthetic RNA molecules containing only adenosine, guanosine, cytidine, and pseudouridine can exhibit excessive toxicity.

It has now been discovered that synthetic RNA molecules containing one or more non-canonical nucleotides that include one or more substitutions at the 2C and/or 4C and/or 5C positions in the case of a pyrimidine or the 6C and/or 7N and/or 8C positions in the case of a purine can be less toxic than synthetic RNA molecules containing only canonical nucleotides, due in part to the ability of substitutions at these positions to interfere with recognition of synthetic RNA molecules by proteins that detect exogenous nucleic acids, and furthermore, that substitutions at these positions can have minimal impact on the efficiency with which the synthetic RNA molecules can be translated into protein, due in part to the lack of interference of substitutions at these positions with base-pairing and base-stacking interactions.

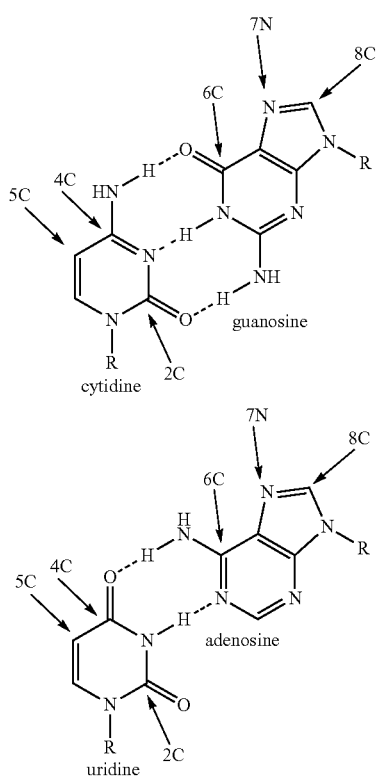

Examples of non-canonical nucleotides that include one or more substitutions at the 2C and/or 4C and/or 5C positions in the case of a pyrimidine or the 6C and/or 7N and/or 8C positions in the case of a purine include, but are not limited to: 2-thiouridine, 5-azauridine, pseudouridine, 4-thiouridine, 5-methyluridine, 5-aminouridine, 5-hydroxyuridine, 5-methyl-5-azauridine, 5-amino-5-azauridine, 5-hydroxy-5-azauridine, 5-methylpseudouridine, 5-aminopseudouridine, 5-hydroxypseudouridine, 4-thio-5-azauridine, 4-thiopseudouridine, 4-thio-5-methyluridine, 4-thio-5-aminouridine, 4-thio-5-hydroxyuridine, 4-thio-5-methyl-5-azauridine, 4-thio-5-amino-5-azauridine, 4-thio-5-hydroxy-5-azauridine, 4-thio-5-methylpseudouridine, 4-thio-5-aminopseudouridine, 4-thio-5-hydroxypseudouridine, 2-thiocytidine, 5-azacytidine, pseudoisocytidine, N4-methylcytidine, N4-aminocytidine, N4-hydroxycytidine, 5-methylcytidine, 5-aminocytidine, 5-hydroxycytidine, 5-methyl-5-azacytidine, 5-amino-5-azacytidine, 5-hydroxy-5-azacytidine, 5-methylpseudoisocytidine, 5-aminopseudoisocytidine, 5-hydroxypseudoisocytidine, N4-methyl-5-azacytidine, N4-methylpseudoisocytidine, 2-thio-5-azacytidine, 2-thiopseudoisocytidine, 2-thio-N4-methylcytidine, 2-thio-N4-aminocytidine, 2-thio-N4-hydroxycytidine, 2-thio-5-methylcytidine, 2-thio-5-aminocytidine, 2-thio-5-hydroxycytidine, 2-thio-5-methyl-5-azacytidine, 2-thio-5-amino-5-azacytidine, 2-thio-5-hydroxy-5-azacytidine, 2-thio-5-methylpseudoisocytidine, 2-thio-5-aminopseudoisocytidine, 2-thio-5-hydroxypseudoisocytidine, 2-thio-N4-methyl-5-azacytidine, 2-thio-N4-methylpseudoisocytidine, N4-methyl-5-methylcytidine, N4-methyl-5-aminocytidine, N4-methyl-5-hydroxycytidine, N4-methyl-5-methyl-5-azacytidine, N4-methyl-5-amino-5-azacytidine, N4-methyl-5-hydroxy-5-azacytidine, N4-methyl-5-methylpseudoisocytidine, N4-methyl-5-aminopseudoisocytidine, N4-methyl-5-hydroxypseudoisocytidine, N4-amino-5-azacytidine, N4-aminopseudoisocytidine, N4-amino-5-methylcytidine, N4-amino-5-aminocytidine, N4-amino-5-hydroxycytidine, N4-amino-5-methyl-5-azacytidine, N4-amino-5-amino-5-azacytidine, N4-amino-5-hydroxy-5-azacytidine, N4-amino-5-methylpseudoisocytidine, N4-amino-5-aminopseudoisocytidine, N4-amino-5-hydroxypseudoisocytidine, N4-hydroxy-5-azacytidine, N4-hydroxypseudoisocytidine, N4-hydroxy-5-methylcytidine, N4-hydroxy-5-aminocytidine, N4-hydroxy-5-hydroxycytidine, N4-hydroxy-5-methyl-5-azacytidine, N4-hydroxy-5-amino-5-azacytidine, N4-hydroxy-5-hydroxy-5-azacytidine, N4-hydroxy-5-methylpseudoisocytidine, N4-hydroxy-5-aminopseudoisocytidine, N4-hydroxy-5-hydroxypseudoisocytidine, 2-thio-N4-methyl-5-methylcytidine, 2-thio-N4-methyl-5-aminocytidine, 2-thio-N4-methyl-5-hydroxycytidine, 2-thio-N4-methyl-5-methyl-5-azacytidine, 2-thio-N4-methyl-5-amino-5-azacytidine, 2-thio-N4-methyl-5-hydroxy-5-azacytidine, 2-thio-N4-methyl-5-methylpseudoisocytidine, 2-thio-N4-methyl-5-aminopseudoisocytidine, 2-thio-N4-methyl-5-hydroxypseudoisocytidine, 2-thio-N4-amino-5-azacytidine, 2-thio-N4-aminopseudoisocytidine, 2-thio-N4-amino-5-methylcytidine, 2-thio-N4-amino-5-aminocytidine, 2-thio-N4-amino-5-hydroxycytidine, 2-thio-N4-amino-5-methyl-5-azacytidine, 2-thio-N4-amino-5-amino-5-azacytidine, 2-thio-N4-amino-5-hydroxy-5-azacytidine, 2-thio-N4-amino-5-methylpseudoisocytidine, 2-thio-N4-amino-5-aminopseudoisocytidine, 2-thio-N4-amino-5-hydroxypseudoisocytidine, 2-thio-N4-hydroxy-5-azacytidine, 2-thio-N4-hydroxypseudoisocytidine, 2-thio-N4-hydroxy-5-methylcytidine, N4-hydroxy-5-aminocytidine, 2-thio-N4-hydroxy-5-hydroxycytidine, 2-thio-N4-hydroxy-5-methyl-5-azacytidine, 2-thio-N4-hydroxy-5-amino-5-azacytidine, 2-thio-N4-hydroxy-5-hydroxy-5-azacytidine, 2-thio-N4-hydroxy-5-methylpseudoisocytidine, 2-thio-N4-hydroxy-5-aminopseudoisocytidine, 2-thio-N4-hydroxy-5-hydroxypseudoisocytidine, N6-methyladenosine, N6-aminoadenosine, N6-hydroxyadenosine, 7-deazaadenosine, 8-azaadenosine, N6-methyl-7-deazaadenosine, N6-methyl-8-azaadenosine, 7-deaza-8-azaadenosine, N6-methyl-7-deaza-8-azaadenosine, N6-amino-7-deazaadenosine, N6-amino-8-azaadenosine, N6-amino-7-deaza-8-azaadenosine, N6-hydroxyadenosine, N6-hydroxy-7-deazaadenosine, N6-hydroxy-8-azaadenosine, N6-hydroxy-7-deaza-8-azaadenosine, 6-thioguanosine, 7-deazaguanosine, 8-azaguanosine, 6-thio-7-deazaguanosine, 6-thio-8-azaguanosine, 7-deaza-8-azaguanosine, and 6-thio-7-deaza-8-azaguanosine. Note that alternative naming schemes exist for certain non-canonical nucleotides. For example, in certain situations, 5-methylpseudouridine can be referred to as "3-methylpseudouridine" or "N3-methylpseudouridine" or "1-methylpseudouridine" or "N1-methylpseudouridine".

Nucleotides that contain the prefix "amino" can refer to any nucleotide that contains a nitrogen atom bound to the atom at the stated position of the nucleotide, for example, 5-aminocytidine can refer to 5-aminocytidine, 5-methylaminocytidine, and 5-nitrocytidine. Similarly, nucleotides that contain the prefix "methyl" can refer to any nucleotide that contains a carbon atom bound to the atom at the stated position of the nucleotide, for example, 5-methylcytidine can refer to 5-methylcytidine, 5-ethylcytidine, and 5-hydroxymethylcytidine, nucleotides that contain the prefix "thio" can refer to any nucleotide that contains a sulfur atom bound to the atom at the given position of the nucleotide, and nucleotides that contain the prefix "hydroxy" can refer to any nucleotide that contains an oxygen atom bound to the atom at the given position of the nucleotide, for example, 5-hydroxyuridine can refer to 5-hydroxyuridine and uridine with a methyl group bound to an oxygen atom, wherein the oxygen atom is bound to the atom at the 5C position of the uridine.

Certain embodiments are therefore directed to a synthetic RNA molecule, wherein the synthetic RNA molecule contains one or more nucleotides that includes one or more substitutions at the 2C and/or 4C and/or 5C positions in the case of a pyrimidine or the 6C and/or 7N and/or 8C positions in the case of a purine. Other embodiments are directed to a therapeutic, wherein the therapeutic contains one or more synthetic RNA molecules, and wherein the one or more synthetic RNA molecules contains one or more nucleotides that includes one or more substitutions at the 2C and/or 4C and/or 5C positions in the case of a pyrimidine or the 6C and/or 7N and/or 8C positions in the case of a purine. In one embodiment, the therapeutic comprises a transfection reagent. In another embodiment, the transfection reagent comprises a cationic lipid, liposome or micelle. In still another embodiment, the liposome or micelle comprises folate and the therapeutic composition has anti-cancer activity. In another embodiment, the one or more nucleotides includes at least one of pseudouridine, 2-thiouridine, 4-thiouridine, 5-azauridine, 5-hydroxyuridine, 5-methyluridine, 5-aminouridine, 2-thiopseudouridine, 4-thiopseudouridine, 5-hydroxypseudouridine, 5-methylpseudouridine, 5-aminopseudouridine, pseudoisocytidine, N4-methylcytidine, 2-thiocytidine, 5-azacytidine, 5-hydroxycytidine, 5-aminocytidine, 5-methylcytidine, N4-methylpseudoisocytidine, 2-thiopseudoisocytidine, 5-hydroxypseudoisocytidine, 5-aminopseudoisocytidine, 5-methylpseudoisocytidine, 7-deazaadenosine, 7-deazaguanosine, 6-thioguanosine, and 6-thio-7-deazaguanosine. In another embodiment, the one or more nucleotides includes at least one of pseudouridine, 2-thiouridine, 4-thiouridine, 5-azauridine, 5-hydroxyuridine, 5-methyluridine, 5-aminouridine, 2-thiopseudouridine, 4-thiopseudouridine, 5-hydroxypseudouridine, 5-methylpseudouridine, and 5-aminopseudouridine and at least one of pseudoisocytidine, N4-methylcytidine, 2-thiocytidine, 5-azacytidine, 5-hydroxycytidine, 5-aminocytidine, 5-methylcytidine, N4-methylpseudoisocytidine, 2-thiopseudoisocytidine, 5-hydroxypseudoisocytidine, 5-aminopseudoisocytidine, and 5-methylpseudoisocytidine. In still another embodiment, the one or more nucleotides include at least one of pseudouridine, 2-thiouridine, 4-thiouridine, 5-azauridine, 5-hydroxyuridine, 5-methyluridine, 5-aminouridine, 2-thiopseudouridine, 4-thiopseudouridine, 5-hydroxypseudouridine, and 5-methylpseudouridine, 5-aminopseudouridine and at least one of pseudoisocytidine, N4-methylcytidine, 2-thiocytidine, 5-azacytidine, 5-hydroxycytidine, 5-aminocytidine, 5-methylcytidine, N4-methylpseudoisocytidine, 2-thiopseudoisocytidine, 5-hydroxypseudoisocytidine, 5-aminopseudoisocytidine, and 5-methylpseudoisocytidine and at least one of 7-deazaguanosine, 6-thioguanosine, and 6-thio-7-deazaguanosine. In yet another embodiment, the one or more nucleotides includes: 5-methylcytidine and 7-deazaguanosine. In another embodiment, the one or more nucleotides also includes pseudouridine or 4-thiouridine or 5-methyluridine or 5-aminouridine or 4-thiopseudouridine or 5-methylpseudouridine or 5-aminopseudouridine. In a still another embodiment, the one or more nucleotides also includes 7-deazaadenosine. In another embodiment, the one or more nucleotides includes: pseudoisocytidine and 7-deazaguanosine and 4-thiouridine. In yet another embodiment, the one or more nucleotides includes: pseudoisocytidine or 7-deazaguanosine and pseudouridine. In still another embodiment, the one or more nucleotides includes: 5-methyluridine and 5-methylcytidine and 7-deazaguanosine. In a further embodiment, the one or more nucleotides includes: pseudouridine or 5-methylpseudouridine and 5-methylcytidine and 7-deazaguanosine. In another embodiment, the one or more nucleotides includes: pseudoisocytidine and 7-deazaguanosine and pseudouridine. In one embodiment, the synthetic RNA molecule is present in vivo.

Certain non-canonical nucleotides can be incorporated more efficiently than other non-canonical nucleotides into synthetic RNA molecules by RNA polymerases that are commonly used for in vitro transcription, due in part to the tendency of these certain non-canonical nucleotides to participate in standard base-pairing interactions and base-stacking interactions, and to interact with the RNA polymerase in a manner similar to that in which the corresponding canonical nucleotide interacts with the RNA polymerase. As a result, certain nucleotide mixtures containing one or more non-canonical nucleotides can be beneficial in part because in vitro-transcription reactions containing these nucleotide mixtures can yield a large quantity of synthetic RNA. Certain embodiments are therefore directed to a nucleotide mixture containing one or more nucleotides that includes one or more substitutions at the 2C and/or 4C and/or 5C positions in the case of a pyrimidine or the 6C and/or 7N and/or 8C positions in the case of a purine. Nucleotide mixtures include, but are not limited to (numbers preceding each nucleotide indicate an exemplary fraction of the non-canonical nucleotide triphosphate in an in vitro-transcription reaction, for example, 0.2 pseudoisocytidine refers to a reaction containing adenosine-5-triphosphate, guanosine-5-triphosphate, uridine-5-triphosphate, cytidine-5'-triphosphate, and pseudoisocytidine-5-triphosphate, wherein pseudoisocytidine-5'-triphosphate is present in the reaction at an amount approximately equal to 0.2 times the total amount of pseudoisocytidine-5'-triphosphate+cytidine-5-triphosphate that is present in the reaction, with amounts measured either on a molar or mass basis, and wherein more than one number preceding a nucleoside indicates a range of exemplary fractions): 1.0 pseudouridine, 0.1-0.8 2-thiouridine, 0.1-0.8 5-methyluridine, 0.2-1.0 5-hydroxyuridine, 0.1-1.0 5-aminouridine, 0.1-1.0 4-thiouridine, 0.1-1.0 2-thiopseudouridine, 0.1-1.0 4-thiopseudouridine, 0.1-1.0 5-hydroxypseudouridine, 0.2-1 5-methylpseudouridine, 0.1-1.0 5-aminopseudouridine, 0.2-1.0 2-thiocytidine, 0.1-0.8 pseudoisocytidine, 0.2-1.0 5-methylcytidine, 0.2-1.0 5-hydroxycytidine, 0.1-1.0 5-aminocytidine, 0.2-1.0 N4-methylcytidine, 0.2-1.0 5-methylpseudoisocytidine, 0.2-1.0 5-hydroxypseudoisocytidine, 0.2-1.0 5-aminopseudoisocytidine, 0.2-1.0 N4-methylpseudoisocytidine, 0.2-1.0 2-thiopseudoisocytidine, 0.2-1.0 7-deazaguanosine, 0.2-1.0 6-thioguanosine, 0.2-1.0 6-thio-7-deazaguanosine, 0.2-1.0 8-azaguanosine, 0.2-1.0 7-deaza-8-azaguanosine, 0.2-1.0 6-thio-8-azaguanosine, 0.1-0.5 7-deazaadenosine, and 0.1-0.5 N6-methyladenosine.

In various embodiments, the synthetic RNA composition or synthetic polynucleotide composition (e.g., which may be prepared by in vitro transcription) contains substantially or entirely the canonical nucleotide at positions having adenine or "A" in the genetic code. The term "substantially" in this context refers to at least 90%. In these embodiments, the synthetic RNA composition or synthetic polynucleotide composition may further contain (e.g., consist of) 7-deazaguanosine at positions with "G" in the genetic code as well as the corresponding canonical nucleotide "G", and the canonical and non-canonical nucleotide at positions with G may be in the range of 5:1 to 1:5, or in some embodiments in the range of 2:1 to 1:2. In these embodiments, the synthetic RNA composition or synthetic polynucleotide composition may further contain (e.g., consist of) one or more (e.g., two, three or four) of 5-hydroxymethylcytidine, 5-hydroxycytidine, 5-carboxycytidine, and 5-formylcytidine at positions with "C" in the genetic code as well as the canonical nucleotide "C", and the canonical and non-canonical nucleotide at positions with C may be in the range of 5:1 to 1:5, or in some embodiments in the range of 2:1 to 1:2. In some embodiments, the level of non-canonical nucleotide at positions of "C" are as described in the preceding paragraph. In these embodiments, the synthetic RNA composition or synthetic polynucleotide composition may further contain (e.g., consist of) one or more (e.g., two, three, or four) of 5-hydroxymethyluridine, 5-hydroxyuridine, 5-carboxyuridine, and 5-formyluridine at positions with "U" in the genetic code as well as the canonical nucleotide "U", and the canonical and non-canonical nucleotide at positions with "U" may be in the range of 5:1 to 1:5, or in some embodiments in the range of 2:1 to 1:2. In some embodiments, the level of non-canonical nucleotide at positions of "U" are as described in the preceding paragraph.

It has now been discovered that combining certain non-canonical nucleotides can be beneficial in part because the contribution of non-canonical nucleotides to lowering the toxicity of synthetic RNA molecules can be additive. Certain embodiments are therefore directed to a nucleotide mixture, wherein the nucleotide mixture contains more than one of the non-canonical nucleotides listed above, for example, the nucleotide mixture contains both pseudoisocytidine and 7-deazaguanosine or the nucleotide mixture contains both N4-methylcytidine and 7-deazaguanosine, etc. In one embodiment, the nucleotide mixture contains more than one of the non-canonical nucleotides listed above, and each of the non-canonical nucleotides is present in the mixture at the fraction listed above, for example, the nucleotide mixture contains 0.1-0.8 pseudoisocytidine and 0.2-1.0 7-deazaguanosine or the nucleotide mixture contains 0.2-1.0 N4-methylcytidine and 0.2-1.0 7-deazaguanosine, etc.

In certain situations, for example, when it may not be necessary or desirable to maximize the yield of an in vitro-transcription reaction, nucleotide fractions other than those given above may be used. The exemplary fractions and ranges of fractions listed above relate to nucleotide-triphosphate solutions of typical purity (greater than 90% purity). Larger fractions of these and other nucleotides can be used by using nucleotide-triphosphate solutions of greater purity, for example, greater than about 95% purity or greater than about 98% purity or greater than about 99% purity or greater than about 99.5% purity, which can be achieved, for example, by purifying the nucleotide triphosphate solution using existing chemical-purification technologies such as high-pressure liquid chromatography (HPLC) or by other means. In one embodiment, nucleotides with multiple isomers are purified to enrich the desired isomer.

Other embodiments are directed to a method for inducing a cell in vivo to express a protein of interest by contacting the cell with a synthetic RNA molecule that contains one or more non-canonical nucleotides that includes one or more substitutions at the 2C and/or 4C and/or 5C positions in the case of a pyrimidine or the 6C and/or 7N and/or 8C positions in the case of a purine. Still other embodiments are directed to a method for transfecting, reprogramming, and/or gene-editing a cell in vivo by contacting the cell with a synthetic RNA molecule that contains one or more non-canonical nucleotides that includes one or more substitutions at the 2C and/or 4C and/or 5C positions in the case of a pyrimidine or the 6C and/or 7N and/or 8C positions in the case of a purine. In one embodiment, the synthetic RNA molecule is produced by in vitro transcription. In one embodiment, the synthetic RNA molecule encodes one or more reprogramming factors. In another embodiment, the one or more reprogramming factors includes Oct4 protein. In another embodiment, the cell is also contacted with a synthetic RNA molecule that encodes Sox2 protein. In yet another embodiment, the cell is also contacted with a synthetic RNA molecule that encodes Klf4 protein. In yet another embodiment, the cell is also contacted with a synthetic RNA molecule that encodes c-Myc protein. In yet another embodiment, the cell is also contacted with a synthetic RNA molecule that encodes Lin28 protein.

Enzymes such as T7 RNA polymerase may preferentially incorporate canonical nucleotides in an in vitro-transcription reaction containing both canonical and non-canonical nucleotides. As a result, an in vitro-transcription reaction containing a certain fraction of a non-canonical nucleotide may yield RNA containing a different, often lower, fraction of the non-canonical nucleotide than the fraction at which the non-canonical nucleotide was present in the reaction. In certain embodiments, references to nucleotide incorporation fractions (for example, "a synthetic RNA molecule containing 50% pseudoisocytidine" or "0.1-0.8 pseudoisocytidine") therefore can refer both to RNA molecules containing the stated fraction of the nucleotide, and to RNA molecules synthesized in a reaction containing the stated fraction of the nucleotide (or nucleotide derivative, for example, nucleotide-triphosphate), even though such a reaction may yield RNA containing a different fraction of the nucleotide than the fraction at which the non-canonical nucleotide was present in the reaction.

Different nucleotide sequences can encode the same protein by utilizing alternative codons. In certain embodiments, references to nucleotide incorporation fractions therefore can refer both to RNA molecules containing the stated fraction of the nucleotide, and to RNA molecules encoding the same protein as a different RNA molecule, wherein the different RNA molecule contains the stated fraction of the nucleotide.

Certain embodiments are directed to a kit containing one or more materials needed to practice the present invention. In one embodiment, the kit contains one or more synthetic RNA molecules. In one embodiment, the kit contains one or more synthetic RNA molecules that encode one or more reprogramming factors and/or gene-editing proteins. In another embodiment, the one or more synthetic RNA molecules contain one or more non-canonical nucleotides that include one or more substitutions at the 2C and/or 4C and/or 5C positions in the case of a pyrimidine or the 6C and/or 7N and/or 8C positions in the case of a purine. In another embodiment, the kit contains one or more of: a transfection medium, a transfection reagent, a complexation medium, and a matrix solution. In one embodiment, the matrix solution contains fibronectin and/or vitronectin or recombinant fibronectin and/or recombinant vitronectin. In one embodiment, one or more of the components of the kit are present as a plurality of aliquots. In one embodiment, the kit contains aliquots of nucleic acid transfection-reagent complexes. In another embodiment, the kit contains aliquots of nucleic acid transfection-reagent complexes that are provided in a solid form, for example, as frozen or freeze-dried pellets. In yet another embodiment, the kit contains aliquots of medium, wherein each aliquot contains transfection reagent-nucleic acid complexes that are stabilized either by chemical treatment or by freezing.

Transfection, in general, and reprogramming, in particular, can be difficult and time-consuming techniques that can be repetitive and prone to error. However, these techniques are often performed manually due to the lack of automated transfection equipment. Certain embodiments are therefore directed to a system that can transfect, reprogram, and/or gene-edit cells in vivo in an automated or semi-automated manner.

It has now been discovered that the non-canonical nucleotide members of the 5-methylcytidine de-methylation pathway, when incorporated into synthetic RNA, can increase the efficiency with which the synthetic RNA can be translated into protein in vivo, and can decrease the toxicity of the synthetic RNA in vivo. These non-canonical nucleotides include, for example: 5-methylcytidine, 5-hydroxymethylcytidine, 5-formylcytidine, and 5-carboxycytidine (a.k.a. "cytidine-5-carboxylic acid"). Certain embodiments are therefore directed to a nucleic acid. In some embodiments, the nucleic acid is present in vivo. In one embodiment, the nucleic acid is a synthetic RNA molecule. In another embodiment, the nucleic acid comprises one or more non-canonical nucleotides. In one embodiment, the nucleic acid comprises one or more non-canonical nucleotide members of the 5-methylcytidine de-methylation pathway. In another embodiment, the nucleic acid comprises at least one of: 5-methylcytidine, 5-hydroxymethylcytidine, 5-formylcytidine, and 5-carboxycytidine or a derivative thereof. In a further embodiment, the nucleic acid comprises at least one of: pseudouridine, 5-methylpseudouridine, 5-hydroxyuridine, 5-methyluridine, 5-methylcytidine, 5-hydroxymethylcytidine, N4-methylcytidine, N4-acetylcytidine, and 7-deazaguanosine or a derivative thereof.

5-methylcytidine De-Methylation Pathway

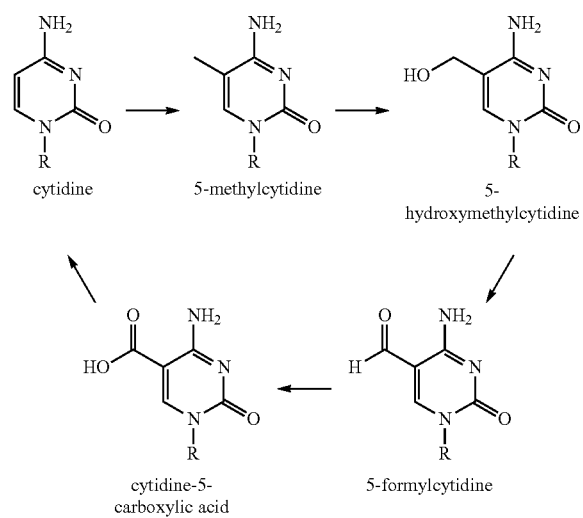

cytidine   5-methylcytidine   5-hydroxymethylcytidine cytidine-5-carboxylic acid   5-formylcytidine Certain embodiments are directed to a protein. Other embodiments are directed to a nucleic acid that encodes a protein. In one embodiment, the protein is a protein of interest. In another embodiment, the protein is selected from: a reprogramming protein and a gene-editing protein. In one embodiment, the nucleic acid is a plasmid. In another embodiment, the nucleic acid is present in a virus or viral vector. In a further embodiment, the virus or viral vector is replication incompetent. In a still further embodiment, the virus or viral vector is replication competent. In one embodiment, the virus or viral vector includes at least one of: an adenovirus, a retrovirus, a lentivirus, a herpes virus, an adeno-associated virus or a natural or engineered variant thereof, and an engineered virus.

It has also been discovered that certain combinations of non-canonical nucleotides can be particularly effective at increasing the efficiency with which synthetic RNA can be translated into protein in vivo, and decreasing the toxicity of synthetic RNA in vivo, for example, the combinations: 5-methyluridine and 5-methylcytidine, 5-hydroxyuridine and 5-methylcytidine, 5-hydroxyuridine and 5-hydroxymethylcytidine, 5-methyluridine and 7-deazaguanosine, 5-methylcytidine and 7-deazaguanosine, 5-methyluridine, 5-methylcytidine, and 7-deazaguanosine, and 5-methyluridine, 5-hydroxymethylcytidine, and 7-deazaguanosine. Certain embodiments are therefore directed to a nucleic acid comprising at least two of: 5-methyluridine, 5-methylcytidine, 5-hydroxymethylcytidine, and 7-deazaguanosine or one or more derivatives thereof. Other embodiments are directed to a nucleic acid comprising at least three of: 5-methyluridine, 5-methylcytidine, 5-hydroxymethylcytidine, and 7-deazaguanosine or one or more derivatives thereof. Other embodiments are directed to a nucleic acid comprising all of: 5-methyluridine, 5-methylcytidine, 5-hydroxymethylcytidine, and 7-deazaguanosine or one or more derivatives thereof. In one embodiment, the nucleic acid comprises one or more 5-methyluridine residues, one or more 5-methylcytidine residues, and one or more 7-deazaguanosine residues or one or more 5-methyluridine residues, one or more 5-hydroxymethylcytidine residues, and one or more 7-deazaguanosine residues.

It has been further discovered that synthetic RNA molecules containing certain fractions of certain non-canonical nucleotides and combinations thereof can exhibit particularly high translation efficiency and low toxicity in vivo. Certain embodiments are therefore directed to a nucleic acid comprising at least one of: one or more uridine residues, one or more cytidine residues, and one or more guanosine residues, and comprising one or more non-canonical nucleotides. In one embodiment, between about 20% and about 80% of the uridine residues are 5-methyluridine residues. In another embodiment, between about 30% and about 50% of the uridine residues are 5-methyluridine residues. In a further embodiment, about 40% of the uridine residues are 5-methyluridine residues. In one embodiment, between about 60% and about 80% of the cytidine residues are 5-methylcytidine residues. In another embodiment, between about 80% and about 100% of the cytidine residues are 5-methylcytidine residues. In a further embodiment, about 100% of the cytidine residues are 5-methylcytidine residues. In a still further embodiment, between about 20% and about 100% of the cytidine residues are 5-hydroxymethylcytidine residues. In one embodiment, between about 20% and about 80% of the guanosine residues are 7-deazaguanosine residues. In another embodiment, between about 40% and about 60% of the guanosine residues are 7-deazaguanosine residues. In a further embodiment, about 50% of the guanosine residues are 7-deazaguanosine residues. In one embodiment, between about 20% and about 80% or between about 30% and about 60% or about 40% of the cytidine residues are N4-methylcytidine and/or N4-acetylcytidine residues. In another embodiment, each cytidine residue is a 5-methylcytidine residue. In a further embodiment, about 100% of the cytidine residues are 5-methylcytidine residues and/or 5-hydroxymethylcytidine residues and/or N4-methylcytidine residues and/or N4-acetylcytidine residues and/or one or more derivatives thereof. In a still further embodiment, about 40% of the uridine residues are 5-methyluridine residues, between about 20% and about 100% of the cytidine residues are N4-methylcytidine and/or N4-acetylcytidine residues, and about 50% of the guanosine residues are 7-deazaguanosine residues. In one embodiment, about 40% of the uridine residues are 5-methyluridine residues and about 100% of the cytidine residues are 5-methylcytidine residues. In another embodiment, about 40% of the uridine residues are 5-methyluridine residues and about 50% of the guanosine residues are 7-deazaguanosine residues. In a further embodiment, about 100% of the cytidine residues are 5-methylcytidine residues and about 50% of the guanosine residues are 7-deazaguanosine residues. In a further embodiment, about 100% of the uridine residues are 5-hydroxyuridine residues. In one embodiment, about 40% of the uridine residues are 5-methyluridine residues, about 100% of the cytidine residues are 5-methylcytidine residues, and about 50% of the guanosine residues are 7-deazaguanosine residues. In another embodiment, about 40% of the uridine residues are 5-methyluridine residues, between about 20% and about 100% of the cytidine residues are 5-hydroxymethylcytidine residues, and about 50% of the guanosine residues are 7-deazaguanosine residues. In some embodiments, less than 100% of the cytidine residues are 5-methylcytidine residues. In other embodiments, less than 100% of the cytidine residues are 5-hydroxymethylcytidine residues. In one embodiment, each uridine residue in the synthetic RNA molecule is a pseudouridine residue or a 5-methylpseudouridine residue. In another embodiment, about 100% of the uridine residues are pseudouridine residues and/or 5-methylpseudouridine residues. In a further embodiment, about 100% of the uridine residues are pseudouridine residues and/or 5-methylpseudouridine residues, about 100% of the cytidine residues are 5-methylcytidine residues, and about 50% of the guanosine residues are 7-deazaguanosine residues.

Other non-canonical nucleotides that can be used in place of or in combination with 5-methyluridine include, but are not limited to: pseudouridine, 5-hydroxyuridine, and 5-methylpseudouridine (a.k.a. "1-methylpseudouridine", a.k.a. "N1-methylpseudouridine") or one or more derivatives thereof. Other non-canonical nucleotides that can be used in place of or in combination with 5-methylcytidine and/or 5-hydroxymethylcytidine include, but are not limited to: pseudoisocytidine, 5-methylpseudoisocytidine, 5-hydroxymethylcytidine, 5-formylcytidine, 5-carboxycytidine, N4-methylcytidine, N4-acetylcytidine or one or more derivatives thereof. In certain embodiments, for example, when performing only a single transfection, injection or delivery or when the cells, tissue, organ or patient being transfected, injected or delivered to are not particularly sensitive to transfection-associated toxicity or innate-immune signaling, the fractions of non-canonical nucleotides can be reduced. Reducing the fraction of non-canonical nucleotides can be beneficial, in part, because reducing the fraction of non-canonical nucleotides can reduce the cost of the nucleic acid. In certain situations, for example, when minimal immunogenicity of the nucleic acid is desired, the fractions of non-canonical nucleotides can be increased.

Enzymes such as T7 RNA polymerase may preferentially incorporate canonical nucleotides in an in vitro-transcription reaction containing both canonical and non-canonical nucleotides. As a result, an in vitro-transcription reaction containing a certain fraction of a non-canonical nucleotide may yield RNA containing a different, often lower, fraction of the non-canonical nucleotide than the fraction at which the non-canonical nucleotide was present in the reaction. In certain embodiments, references to nucleotide incorporation fractions (for example, "50% 5-methyluridine") therefore can refer both to nucleic acids containing the stated fraction of the nucleotide, and to nucleic acids synthesized in a reaction containing the stated fraction of the nucleotide (or nucleotide derivative, for example, nucleotide-triphosphate), even though such a reaction may yield a nucleic acid containing a different fraction of the nucleotide than the fraction at which the non-canonical nucleotide was present in the reaction. In addition, different nucleotide sequences can encode the same protein by utilizing alternative codons. In certain embodiments, references to nucleotide incorporation fractions therefore can refer both to nucleic acids containing the stated fraction of the nucleotide, and to nucleic acids encoding the same protein as a different nucleic acid, wherein the different nucleic acid contains the stated fraction of the nucleotide.

The DNA sequence of a cell can be altered by contacting the cell with a gene-editing protein or by inducing the cell to express a gene-editing protein. However, previously disclosed gene-editing proteins suffer from low binding efficiency and excessive off-target activity, which can introduce undesired mutations in the DNA of the cell, severely limiting their use in vivo, for example in therapeutic and cosmetic applications, in which the introduction of undesired mutations in a patient's cells could lead to the development of cancer. It has now been discovered that gene-editing proteins that comprise the Stsl endonuclease cleavage domain (SEQ ID NO: 1) can exhibit substantially lower off-target activity in vivo than previously disclosed gene-editing proteins, while maintaining a high level of on-target activity in vivo. Other novel engineered proteins have also been discovered that can exhibit high on-target activity in vivo, low off-target activity in vivo, small size, solubility, and other desirable characteristics when they are used as the nuclease domain of a gene-editing protein: Stsl-HA (SEQ ID NO: 2), Stsl-HA2 (SEQ ID NO: 3), Stsl-UHA (SEQ ID NO: 4), Stsl-UHA2 (SEQ ID NO: 5), Stsl-HF (SEQ ID NO: 6), and Stsl-UHF (SEQ ID NO: 7). Stsl-HA, Stsl-HA2 (high activity), Stsl-UHA, and Stsl-UHA2 (ultra-high activity) can exhibit higher on-target activity in vivo than both wild-type Stsl and wild-type Fokl, due in part to specific amino-acid substitutions within the N-terminal region at the 34 and 61 positions, while Stsl-HF (high fidelity) and Stsl-UHF (ultra-high fidelity) can exhibit lower off-target activity in vivo than both wild-type Stsl and wild-type Fokl, due in part to specific amino-acid substitutions within the C-terminal region at the 141 and 152 positions.

Certain embodiments are therefore directed to a protein. In some embodiments, the protein is present in vivo. In other embodiments, the protein comprises a nuclease domain. In one embodiment, the nuclease domain comprises one or more of: the cleavage domain of Fokl endonuclease (SEQ ID NO: 53), the cleavage domain of Stsl endonuclease (SEQ ID NO: 1), Stsl-HA (SEQ ID NO: 2), Stsl-HA2 (SEQ ID NO: 3), Stsl-UHA (SEQ ID NO: 4), Stsl-UHA2 (SEQ ID NO: 5), Stsl-HF (SEQ ID NO: 6), and Stsl-UHF (SEQ ID NO: 7) or a biologically active fragment or variant thereof.

It has also been discovered that engineered gene-editing proteins that comprise DNA-binding domains comprising certain novel repeat sequences can exhibit lower off-target activity in vivo than previously disclosed gene-editing proteins, while maintaining a high level of on-target activity in vivo. Certain of these engineered gene-editing proteins can provide several advantages over previously disclosed gene-editing proteins, including, for example, increased flexibility of the linker region connecting repeat sequences, which can result in increased binding efficiency. Certain embodiments are therefore directed to a protein comprising a plurality of repeat sequences. In one embodiment, at least one of the repeat sequences contains the amino-acid sequence: GabG, where "a" and "b" each represent any amino acid. In one embodiment, the protein is a gene-editing protein. In another embodiment, one or more of the repeat sequences are present in a DNA-binding domain. In a further embodiment, "a" and "b" are each independently selected from the group: H and G. In a still further embodiment, "a" and "b" are H and G, respectively. In one embodiment, the amino-acid sequence is present within about 5 amino acids of the C-terminus of the repeat sequence. In another embodiment, the amino-acid sequence is present at the C-terminus of the repeat sequence. In some embodiments, one or more G in the amino-acid sequence GabG is replaced with one or more amino acids other than G, for example A, H or GG. In one embodiment, the repeat sequence has a length of between about 32 and about 40 amino acids or between about 33 and about 39 amino acids or between about 34 and 38 amino acids or between about 35 and about 37 amino acids or about 36 amino acids or greater than about 32 amino acids or greater than about 33 amino acids or greater than about 34 amino acids or greater than about 35 amino acids. Other embodiments are directed to a protein comprising one or more transcription activator-like effector domains. In one embodiment, at least one of the transcription activator-like effector domains comprises a repeat sequence. Other embodiments are directed to a protein comprising a plurality of repeat sequences generated by inserting one or more amino acids between at least two of the repeat sequences of a transcription activator-like effector domain. In one embodiment, one or more amino acids is inserted about 1 or about 2 or about 3 or about 4 or about 5 amino acids from the C-terminus of at least one repeat sequence. Still other embodiments are directed to a protein comprising a plurality of repeat sequences, wherein about every other repeat sequence has a different length than the repeat sequence immediately preceding or following the repeat sequence. In one embodiment, every other repeat sequence is about 36 amino acids long. In another embodiment, every other repeat sequence is 36 amino acids long. Still other embodiments are directed to a protein comprising a plurality of repeat sequences, wherein the plurality of repeat sequences comprises at least two repeat sequences that are each at least 36 amino acids long, and wherein at least two of the repeat sequences that are at least 36 amino acids long are separated by at least one repeat sequence that is less than 36 amino acids long. Some embodiments are directed to a protein that comprises one or more sequences selected from, for example, SEQ ID NO: 54, SEQ ID NO: 55, SEQ ID NO: 56, SEQ ID NO: 57, SEQ ID NO: 58, SEQ ID NO: 59, and SEQ ID NO: 60.

Other embodiments are directed to a protein that comprises a DNA-binding domain. In some embodiments, the DNA-binding domain comprises a plurality of repeat sequences. In one embodiment, the plurality of repeat sequences enables high-specificity recognition of a binding site in a target DNA molecule. In another embodiment, at least two of the repeat sequences have at least about 50%, or about 60%, or about 70%, or about 80%, or about 90%, or about 95%, or about 98%, or about 99% homology to each other. In a further embodiment, at least one of the repeat sequences comprises one or more regions capable of binding to a binding site in a target DNA molecule. In a still further embodiment, the binding site comprises a defined sequence of between about 1 to about 5 bases in length. In one embodiment, the DNA-binding domain comprises a zinc finger. In another embodiment, the DNA-binding domain comprises a transcription activator-like effector (TALE). In a further embodiment, the plurality of repeat sequences includes at least one repeat sequence having at least about 50% or about 60% or about 70% or about 80% or about 90% or about 95% or about 98%, or about 99% homology to a TALE. In a still further embodiment, the gene-editing protein comprises a clustered regularly interspaced short palindromic repeat (CRISPR)-associated protein. In one embodiment, the gene-editing protein comprises a nuclear-localization sequence.

In another embodiment, the nuclear-localization sequence comprises the amino-acid sequence: PKKKRKV (SED ID NO: 164). In one embodiment, the gene-editing protein comprises a mitochondrial-localization sequence. In another embodiment, the mitochondrial-localization sequence comprises the amino-acid sequence: LGRVIPRKIASRASLM (SED ID NO: 165). In one embodiment, the gene-editing protein comprises a linker. In another embodiment, the linker connects a DNA-binding domain to a nuclease domain. In a further embodiment, the linker is between about 1 and about 10 amino acids long. In some embodiments, the linker is about 1, about 2, or about 3, or about 4, or about 5, or about 6, or about 7, or about 8, or about 9, or about 10 amino acids long. In one embodiment, the gene-editing protein is capable of generating a nick or a double-strand break in a target DNA molecule.

Certain embodiments are directed to a method for modifying the genome of a cell in vivo, the method comprising introducing into a cell in vivo a nucleic acid molecule encoding a non-naturally occurring fusion protein comprising an artificial transcription activator-like (TAL) effector repeat domain comprising one or more repeat units 36 amino acids in length and an endonuclease domain, wherein the repeat domain is engineered for recognition of a predetermined nucleotide sequence, and wherein the fusion protein recognizes the predetermined nucleotide sequence. In one embodiment, the cell is a eukaryotic cell. In another embodiment, the cell is an animal cell. In a further embodiment, the cell is a mammalian cell. In a still further embodiment, the cell is a human cell. In one embodiment, the cell is a plant cell. In another embodiment, the cell is a prokaryotic cell. In some embodiments, the fusion protein introduces an endonucleolytic cleavage in a nucleic acid of the cell, whereby the genome of the cell is modified.

Certain embodiments are directed to a composition for altering the DNA sequence of a cell in vivo comprising a nucleic acid, wherein the nucleic acid encodes a gene-editing protein. Other embodiments are directed to a composition for altering the DNA sequence of a cell in vivo comprising a nucleic-acid mixture, wherein the nucleic-acid mixture comprises: a first nucleic acid that encodes a first gene-editing protein, and a second nucleic acid that encodes a second gene-editing protein. In one embodiment, the binding site of the first gene-editing protein and the binding site of the second gene-editing protein are present in the same target DNA molecule. In another embodiment, the binding site of the first gene-editing protein and the binding site of the second gene-editing protein are separated by less than about 50 bases, or less than about 40 bases, or less than about 30 bases or less than about 20 bases, or less than about 10 bases, or between about 10 bases and about 25 bases or about 15 bases. In one embodiment, the nuclease domain of the first gene-editing protein and the nuclease domain of the second gene-editing protein are capable of forming a dimer. In another embodiment, the dimer is capable of generating a nick or double-strand break in a target DNA molecule.

Certain embodiments are directed to a therapeutic composition. Other embodiments are directed to a cosmetic composition. In some embodiments, the composition comprises a repair template. In a further embodiment, the repair template is a single-stranded DNA molecule or a double-stranded DNA molecule.

Other embodiments are directed to an article of manufacture for synthesizing a protein or a nucleic acid encoding a protein. In one embodiment, the article is a nucleic acid. In another embodiment, the protein comprises a DNA-binding domain. In a further embodiment, the nucleic acid comprises a nucleotide sequence encoding a DNA-binding domain. In one embodiment, the protein comprises a nuclease domain. In another embodiment, the nucleic acid comprises a nucleotide sequence encoding a nuclease domain. In one embodiment, the protein comprises a plurality of repeat sequences. In another embodiment, the nucleic acid encodes a plurality of repeat sequences. In a further embodiment, the nuclease domain is selected from: FokI, StsI, StsI-HA, StsI-HA2, StsI-UHA, StsI-UHA2, StsI-HF, and StsI-UHF or a natural or engineered variant or biologically active fragment thereof. In one embodiment, the nucleic acid comprises an RNA-polymerase promoter. In another embodiment, the RNA-polymerase promoter is a T7 promoter or a SP6 promoter. In a further embodiment, the nucleic acid comprises a viral promoter. In one embodiment, the nucleic acid comprises an untranslated region. In another embodiment, the nucleic acid is an in vitro-transcription template.

Certain embodiments are directed to a method for inducing a cell to express a protein in vivo. Other embodiments are directed to a method for altering the DNA sequence of a cell in vivo comprising transfecting the cell in vivo with a gene-editing protein or inducing the cell to express a gene-editing protein in vivo. Still other embodiments are directed to a method for reducing the expression of a protein of interest in a cell in vivo. In one embodiment, the cell is induced to express a gene-editing protein, wherein the gene-editing protein is capable of creating a nick or a double-strand break in a target DNA molecule. In another embodiment, the nick or double-strand break results in inactivation of a gene. Still other embodiments are directed to a method for generating an inactive, reduced-activity or dominant-negative form of a protein in vivo. In one embodiment, the protein is survivin. Still other embodiments are directed to a method for repairing one or more mutations in a cell in vivo. In one embodiment, the cell is contacted with a repair template. In another embodiment, the repair template is a DNA molecule. In a further embodiment, the repair template does not contain a binding site of the gene-editing protein. In a still further embodiment, the repair template encodes an amino-acid sequence that is encoded by a DNA sequence that comprises a binding site of the gene-editing protein.

Other embodiments are directed to a method for treating a patient comprising administering to the patient a therapeutically or cosmetically effective amount of a protein or a nucleic acid encoding a protein. In one embodiment, the treatment results in one or more of the patient's symptoms being ameliorated. Certain embodiments are directed to a method for treating a patient comprising: a. inducing a cell to express a protein of interest by transfecting the cell in vivo with a nucleic acid encoding the protein of interest and/or b. reprogramming the cell in vivo. In one embodiment, the cell is reprogrammed to a less differentiated state. In another embodiment, the cell is reprogrammed by transfecting the cell with one or more synthetic RNA molecules encoding one or more reprogramming proteins. In a further embodiment, the cell is differentiated. In a still further embodiment, the cell is differentiated into one of: a skin cell, a glucose-responsive insulin-producing cell, a hematopoietic cell, a cardiac cell, a retinal cell, a renal cell, a neural cell, a stromal cell, a fat cell, a bone cell, a muscle cell, an oocyte, and a sperm cell. Other embodiments are directed to a method for treating a patient comprising: a. inducing a cell to express a gene-editing protein by transfecting the cell in vivo with a nucleic acid encoding a gene-editing protein and/or b. reprogramming the cell in vivo.

Other embodiments are directed to a complexation medium. In one embodiment, the complexation medium has a pH greater than about 7, or greater than about 7.2, or greater than about 7.4, or greater than about 7.6, or greater than about 7.8, or greater than about 8.0, or greater than about 8.2, or greater than about 8.4, or greater than about 8.6, or greater than about 8.8, or greater than about 9.0. In another embodiment, the complexation medium comprises transferrin. In a further embodiment, the complexation medium comprises DMEM. In a still further embodiment, the complexation medium comprises DMEM/F12. Still other embodiments are directed to a method for forming nucleic-acid-transfection-reagent complexes. In one embodiment, the transfection reagent is incubated with a complexation medium. In another embodiment, the incubation occurs before a mixing step. In a further embodiment, the incubation step is between about 5 seconds and about 5 minutes or between about 10 seconds and about 2 minutes or between about 15 seconds and about 1 minute or between about 30 seconds and about 45 seconds. In one embodiment, the transfection reagent is selected from Table 2. In another embodiment, the transfection reagent is a lipid or lipidoid. In a further embodiment, the transfection reagent comprises a cation. In a still further embodiment, the cation is a multivalent cation. In a still further embodiment, the transfection reagent is N1-[2-((1S)-1-[(3-aminopropyl)amino]-4-[di(3-amino-propyl)amino]butylcarboxamido)ethyl]-3,4-di[oleyloxy]-benzamide (a.k.a. MVL5) or a derivative thereof.

Certain embodiments are directed to a method for inducing a cell to express a protein by contacting the cell with a nucleic acid in vivo. In one embodiment, the cell is a mammalian cell. In another embodiment, the cell is a human cell or a rodent cell. Other embodiments are directed to a cell produced using one or more of the methods of the present invention. In one embodiment, the cell is present in a patient. In another embodiment, the cell is isolated from a patient. Other embodiments are directed to a screening library comprising a cell produced using one or more of the methods of the present invention. In one embodiment, the screening library is used for at least one of: toxicity screening, including: cardiotoxicity screening, neurotoxicity screening, and hepatotoxicity screening, efficacy screening, high-throughput screening, high-content screening, and other screening.

Other embodiments are directed to a kit containing a nucleic acid. In one embodiment, the kit contains a delivery reagent (a.k.a. "transfection reagent"). In another embodiment, the kit is a reprogramming kit. In a further embodiment, the kit is a gene-editing kit. Other embodiments are directed to a kit for producing nucleic acids. In one embodiment, the kit contains at least two of: pseudouridine-triphosphate, 5-methyluridine triphosphate, 5-methylcytidine triphosphate, 5-hydroxymethylcytidine triphosphate, N4-methylcytidine triphosphate, N4-acetylcytidine triphosphate, and 7-deazaguanosine triphosphate or one or more derivatives thereof. Other embodiments are directed to a therapeutic or cosmetic comprising a nucleic acid. In one embodiment, the therapeutic or cosmetic is a pharmaceutical composition. In another embodiment, the pharmaceutical composition is formulated. In a further embodiment, the formulation comprises an aqueous suspension of liposomes. Example liposome components are set forth in Table 2, and are given by way of example, and not by way of limitation. In one embodiment, the liposomes include one or more polyethylene glycol (PEG) chains. In another embodiment, the PEG is PEG2000. In a further embodiment, the liposomes include 1,2-distearoyl-sn-glycero-3-phosphoethanolamine (DSPE) or a derivative thereof. In one embodiment, the therapeutic comprises one or more ligands. In another embodiment, the therapeutic comprises at least one of: androgen, CD30 (TNFRSF8), a cell-penetrating peptide, CXCR, estrogen, epidermal growth factor, EGFR, HER2, folate, insulin, insulin-like growth factor-I, interleukin-13, integrin, progesterone, stromal-derived-factor-1, thrombin, vitamin D, and transferrin or a biologically active fragment or variant thereof. Still other embodiments are directed to a therapeutic or cosmetic comprising a cell generated using one or more of the methods of the present invention. In one embodiment, the therapeutic is administered to a patient for the treatment of at least one of: type 1 diabetes, heart disease, including ischemic and dilated cardiomyopathy, macular degeneration, Parkinson's disease, cystic fibrosis, sickle-cell anemia, thalassemia, Fanconi anemia, severe combined immunodeficiency, hereditary sensory neuropathy, xeroderma pigmentosum, Huntington's disease, muscular dystrophy, amyotrophic lateral sclerosis, Alzheimer's disease, cancer, and infectious diseases including: hepatitis and HIV/AIDS.

TABLE 2

Illustrative Biocompatible Lipids 1  3β-[N-(N',N'-dimethylaminoethane)-carbamoyl]cholesterol (DC-Cholesterol)
2  1,2-dioleoyl-3-trimethylammonium-propane (DOTAP/18:1 TAP)
3  N-(4-carboxybenzyl)-N,N-dimethyl-2,3-bis(oleoyloxy)propan-1-aminium (DOBAQ)
4  1,2-dimyristoyl-3-trimethylammonium-propane (14:0 TAP)
5  1,2-dipalmitoyl-3-trimethylammonium-propane (16:0 TAP)
6  1,2-stearoyl-3-trimethylammonium-propane (18:0 TAP)
7  1,2-dioleoyl-3-dimethylammonium-propane (DODAP/18:1 DAP)
8  1,2-dimyristoyl-3-dimethylammonium-propane (14:0 DAP)
9  1,2-dipalmitoyl-3-dimethylammonium-propane (16:0 DAP)
10 1,2-distearoyl-3-dimethylammonium-propane (18:0 DAP)
11 dimethyldioctadecylammonium (18:0 DDAB)
12 1,2-dilauroyl-sn-glycero-3-ethylphosphocholine (12:0 EthylPC)
13 1,2-dimyristoyl-sn-glycero-3-ethylphosphocholine (14:0 EthylPC)
14 1,2-dimyristoleoyl-sn-glycero-3-ethylphosphocholine (14:1 EthylPC)
15 1,2-dipalmitoyl-sn-glycero-3-ethylphosphocholine (16:0 EthylPC)
16 1,2-distearoyl-sn-glycero-3-ethylphosphocholine (18:0 EthylPC)
17 1,2-dioleoyl-sn-glycero-3-ethylphosphocholine (18:1 EthylPC)
18 1-palmitoyl-2-oleoyl-sn-glycero-3-ethylphosphocholine (16:1-18:1 EthylPC)
19 1,2-di-O-octadecenyl-3-trimethylammonium propane (DOTMA)

TABLE 2-continued

Illustrative Biocompatible Lipids

20 N1-[2-((1S)-1-[(3-aminopropyl)amino]-4-[di(3-aminopropyl)amino]butylcarboxamido)ethyl]-3,4-di[oleyloxy]-benzamide (MVL5)
21 2,3-dioleyloxy-N-[2-spermine carboxamide]ethyl-N,N-dimethyl-1-propanammonium trifluoroacetate (DOSPA)
22 1,3-di-oleyloxy-2-(6-carboxy-spermyl)-propylamid (DOSPER)
23 N-[1-(2,3-dimyristyloxy)propyl]-N,N-dimethyl-N-(2-hydroxyethyl)ammonium bromide (DMRIE)
24 dioctadecyl amidoglyceryl spermine (DOGS)
25 dioleoyl phosphatidyl ethanolamine (DOPE)

In some embodiments, the present invention relates to one or more administration techniques described in U.S. Pat. Nos. 5,711,964; 5,891,468; 6,316,260; 6,413,544; 6,770,291; and 7,390,780, the entire contents of which are hereby incorporated by reference in their entireties.

Certain embodiments are directed to a nucleic acid comprising a 5'-cap structure selected from Cap 0, Cap 1, Cap 2, and Cap 3 or a derivative thereof. In one embodiment, the nucleic acid comprises one or more UTRs. In another embodiment, the one or more UTRs increase the stability of the nucleic acid. In a further embodiment, the one or more UTRs comprise an alpha-globin or beta-globin 5'-UTR. In a still further embodiment, the one or more UTRs comprise an alpha-globin or beta-globin 3'-UTR. In a still further embodiment, the synthetic RNA molecule comprises an alpha-globin or beta-globin 5'-UTR and an alpha-globin or beta-globin 3'-UTR. In one embodiment, the 5'-UTR comprises a Kozak sequence that is substantially similar to the Kozak consensus sequence. In another embodiment, the nucleic acid comprises a 3-poly(A) tail. In a further embodiment, the 3'-poly(A) tail is between about 20 nt and about 250 nt or between about 120 nt and about 150 nt long. In a further embodiment, the 3'-poly(A) tail is about 20 nt, or about 30 nt, or about 40 nt, or about 50 nt, or about 60 nt, or about 70 nt, or about 80 nt, or about 90 nt, or about 100 nt, or about 110 nt, or about 120 nt, or about 130 nt, or about 140 nt, or about 150 nt, or about 160 nt, or about 170 nt, or about 180 nt, or about 190 nt, or about 200 nt, or about 210 nt, or about 220 nt, or about 230 nt, or about 240 nt, or about 250 nt long.

Other embodiments are directed to a method for reprogramming a cell in vivo. In one embodiment, the cell is reprogrammed by contacting the cell with one or more nucleic acids. In one embodiment, the cell is contacted with a plurality of nucleic acids encoding at least one of: Oct4 protein, Sox2 protein, Klf4 protein, c-Myc protein, Lin28 protein or a biologically active fragment, variant or derivative thereof. In another embodiment, the cell is contacted with a plurality of nucleic acids encoding a plurality of proteins including: Oct4 protein, Sox2 protein, Klf4 protein, and c-Myc protein or one or more biologically active fragments, variants or derivatives thereof. Still other embodiments are directed to a method for gene editing a cell in vivo. In one embodiment, the cell is gene-edited by contacting the cell with one or more nucleic acids.

Nucleic acids, including liposomal formulations containing nucleic acids, when delivered in vivo, can accumulate in the liver and/or spleen. It has now been discovered that nucleic acids encoding proteins can modulate protein expression in the liver and spleen, and that nucleic acids used in this manner can constitute potent therapeutics for the treatment of liver and spleen diseases. Certain embodiments are therefore directed to a method for treating liver and/or spleen disease by delivering to a patient a nucleic acid encoding a protein of interest. Other embodiments are directed to a therapeutic composition comprising a nucleic acid encoding a protein of interest, for the treatment of liver and/or spleen disease. Diseases and conditions of the liver and/or spleen that can be treated include, but are not limited to: hepatitis, alcohol-induced liver disease, drug-induced liver disease, Epstein Barr virus infection, adenovirus infection, cytomegalovirus infection, toxoplasmosis, Rocky Mountain spotted fever, non-alcoholic fatty liver disease, hemochromatosis, Wilson's Disease, Gilbert's Disease, and cancer of the liver and/or spleen.

Certain embodiments are directed to a method for inducing a cell in vivo to express a protein of interest comprising contacting a cell in vivo with a solution comprising albumin that is treated with an ion-exchange resin or charcoal and one or more nucleic acid molecules, wherein at least one of the one or more nucleic acid molecules encodes a protein of interest. In one embodiment, the method results in the cell expressing the protein of interest. In another embodiment, the one or more nucleic acid molecules comprise a synthetic RNA molecule. In one embodiment, the cell is a skin cell. In another embodiment, the cell is a muscle cell. In yet another embodiment, the cell is a dermal fibroblast. In yet another embodiment, the cell is a myoblast. In one embodiment, the protein of interest is an extracellular matrix protein. In another embodiment, the protein of interest is selected from: elastin, collagen, laminin, fibronectin, vitronectin, lysyl oxidase, elastin binding protein, a growth factor, fibroblast growth factor, transforming growth factor beta, granulocyte colony-stimulating factor, a matrix metalloproteinase, an actin, fibrillin, microfibril-associated glycoprotein, a lysyl-oxidase-like protein, and platelet-derived growth factor. In one embodiment, the solution is delivered to the dermis. In another embodiment, the delivering is by injection. In yet another embodiment, the delivering is by injection using a microneedle array. In one embodiment, the solution further comprises a growth factor. In another embodiment, the growth factor is selected from: fibroblast growth factor and transforming growth factor beta. In yet another embodiment, the solution further comprises cholesterol.

Other embodiments are directed to a method for inducing a cell in vivo to express a protein of interest comprising contacting a cell in vivo with a solution comprising cholesterol and one or more nucleic acid molecules, wherein at least one of the one or more nucleic acid molecules encodes a protein of interest. In one embodiment, the method results in the cell expressing the protein of interest. Still other embodiments are directed to a method for transfecting a cell in vivo with a nucleic acid molecule comprising contacting a cell in vivo with a solution comprising albumin that is treated with an ion-exchange resin or charcoal and a nucleic acid molecule. In one embodiment, the method results in the cell being transfected with the nucleic acid molecule. In another embodiment, the nucleic acid molecule is one of: a dsDNA molecule, a ssDNA molecule, a dsRNA molecule, a ssRNA molecule, a plasmid, an oligonucleotide, a synthetic RNA molecule, a miRNA molecule, an mRNA molecule, an siRNA molecule. Still other embodiments are directed to a method for treating a patient comprising delivering to a patient a composition comprising albumin that is treated with an ion-exchange resin or charcoal and one or more nucleic acid molecules, wherein at least one of the one or more nucleic acid molecules encodes a protein of interest. In one embodiment, the method results in the expression of the protein of interest in the patient. In another embodiment, the method results in the expression of the protein of interest in the dermis of the patient.

Certain embodiments are directed to a cosmetic composition comprising albumin that is treated with an ion-exchange resin or charcoal and a nucleic acid molecule. Other embodiments are directed to a cosmetic treatment article. In one embodiment, the cosmetic treatment article comprises a device configured to deliver a composition to a patient. In another embodiment, the nucleic acid molecule encodes elastin protein or collagen protein. Still other embodiments are directed to a solution for transfecting a cell in vivo comprising cholesterol or a cholesterol analog and one or more nucleic acid molecules. In one embodiment, the cholesterol or cholesterol analog is covalently bound to at least one of the one or more nucleic acid molecules. In another embodiment, the cholesterol analog is an oxysterol. In yet another embodiment, the cholesterol analog includes one or more of: an A-ring substitution, a B-ring substitution, a D-ring substitution, a side-chain substitution, a cholestanoic acid, a cholestenoic acid, a polyunsaturated moiety, a deuterated moiety, a fluorinated moiety, a sulfonated moiety, a phosphorylated moiety, and a fluorescent moiety. In yet another embodiment, the method comprises treating the patient with one or more of: a dermal filler, a neurotoxin (by way of illustration sodium channel inhibitors (e.g., tetrodotoxin), potassium channel inhibitors (e.g., tetraethylammonium), chloride channel inhibitors (e.g., chlorotoxin and curare), calcium channel inhibitors (e.g., conotoxin), synaptic vesicle release inhibitors (e.g., botulinum toxin and tetanus toxin) and blood brain barrier inhibitor (e.g., aluminum and mercury)) and a repair-inducing treatment.

For instance, botulinum toxin type A has been approved by the U.S. Food and Drug Administration (FDA) for the treatment of essential blepharospasm, strabismus and hemifacial spasm in patients over the age of twelve, cervical dystonia, glabellar line (facial) wrinkles and for treating hyperhydrosis and botulinum toxin type B has been approved for the treatment of cervical dystonia. The present compositions may be combined with these toxins in the treatment of these diseases.

Further the combination of any one of the aforementioned toxins may be used in combination with the present compositions for various cosmetic procedures, including, without limitation, facial wrinkles, hyperkinetic skin lines, glabellar lines, crow's feet, marionette lines, skin disorders, nasolabial folds, blepharospasm, strabismus, hemifacial spasms and sweating disorders. Alternatively, the present compositions may be used to in these cosmetic procedures as a monotherapy.

Certain embodiments are directed to a combination therapy comprising one or more of the therapeutic or cosmetic compositions of the present invention and one or more adjuvant therapies or cosmetic treatments. In certain embodiments, one or more of the therapeutic or cosmetic compositions of the present invention are administered to a subject which is undergoing treatment with one or more adjuvant therapies or cosmetic treatments. Example adjuvant therapies and cosmetic treatments are set forth in Table 3 and Table 5 of U.S. Provisional Application No. 61/721, 302, the contents of which are hereby incorporated by reference, and are given by way of example, and not by way of limitation.

TABLE 3

Illustrative Adjuvant Therapies

| Therapy/Treatment Class | Disease/Condition | Example Therapy/Treatment |
|---|---|---|
| Acetylcholinesterase inhibitors | Myasthenia gravis, Glaucoma, Alzheimer's disease, Lewy body dementia, Postural tachycardia syndrome | Edrophonium |
| Angiotensin-converting-enzyme inhibitor | Hypertension, Congestive heart failure | Perindopril |
| Alkylating agents | Cancer | Cisplatin |
| Angiogenesis inhibitors | Cancer, Macular degeneration | Bevacizumab |
| Angiotensin II receptor antagonists | Hypertension, Diabetic nephropathy, Congestive heart failure | Valsartan |
| Antibiotics | Bacterial infection | Amoxicillin |
| Antidiabetic drugs | Diabetes | Metformin |
| Antimetabolites | Cancer, Infection | 5-fluorouracil (5FU) |
| Antisense oligonucleotides | Cancer, Diabetes, Amyotrophic lateral sclerosis (ALS), Hypercholesterolemia | Mipomersen |
| Cytotoxic antibiotics | Cancer | Doxorubicin |
| Deep-brain stimulation | Chronic pain, Parkinson's disease, Tremor, Dystonia | N/A |
| Dopamine agonists | Parkinson's disease, Type II diabetes, Pituitary tumors | Bromocriptine |
| Entry/Fusion inhibitors | HIV/AIDS | Maraviroc |
| Glucagon-like peptide-1 agonists | Diabetes | Exenatide |
| Glucocorticoids | Asthma, Adrenal insufficiency, Inflammatory diseases, Immune diseases, Bacterial meningitis | Dexamethasone |
| Immunosuppressive drugs | Organ transplantation, Inflammatory diseases, Immune diseases | Azathioprine |
| Insulin/Insulin analogs | Diabetes | NPH insulin |
| Integrase inhibitors | HIV/AIDS | Raltegravir |
| MAO-B inhibitors | Parkinson's disease, Depression, Dementia | Selegiline |
| Maturation inhibitors | HIV/AIDS | Bevirimat |
| Nucleoside analog reverse-transcriptase inhibitors | HIV/AIDS, Hepatitis B | Lamivudine |
| Nucleotide analog reverse-transcriptase inhibitors | HIV/AIDS, Hepatitis B | Tenofovir |
| Non-nucleoside reverse-transcriptase inhibitors | HIV/AIDS | Rilpivirine |
| Pegylated interferon | Hepatitis B/C, Multiple sclerosis | Interferon beta-1a |
| Plant alkaloids/terpenoids | Cancer | Paclitaxel |
| Protease inhibitors | HIV/AIDS, Hepatitis C, Other viral infections | Telaprevir |
| Radiotherapy | Cancer | Brachytherapy |
| Renin inhibitors | Hypertension | Aliskiren |
| Statins | Hypercholesterolemia | Atorvastatin |
| Topoisomerase inhibitors | Cancer | Topotecan |
| Vasopressin receptor antagonist | Hyponatremia, Kidney disease | Tolvaptan |
| Dermal filler | Wrinkles, aged skin | Hyaluronic Acid |
| Botulinum toxin | Wrinkles, aged skin | botulinum toxin type A |
| Induction of skin repair | Acne scars, aged skin | Laser treatment, dermabrasion |

Pharmaceutical preparations may additionally comprise delivery reagents (a.k.a. "transfection reagents") and/or excipients. Pharmaceutically acceptable delivery reagents, excipients, and methods of preparation and use thereof, including methods for preparing and administering pharmaceutical preparations to patients (a.k.a. "subjects") are well known in the art, and are set forth in numerous publications, including, for example, in US Patent Appl. Pub. No. US 2008/0213377, the entirety of which is incorporated herein by reference.

For example, the present compositions can be in the form of pharmaceutically acceptable salts. Such salts include those listed in, for example, *J. Pharma. Sci.* 66, 2-19 (1977) and *The Handbook of Pharmaceutical Salts; Properties, Selection, and Use*. P. H. Stahl and C. G. Wermuth (eds.), Verlag, Zurich (Switzerland) 2002, which are hereby incorporated by reference in their entirety. Non-limiting examples of pharmaceutically acceptable salts include: sulfate, citrate, acetate, oxalate, chloride, bromide, iodide, nitrate, bisulfate, phosphate, acid phosphate, isonicotinate, lactate, salicylate, acid citrate, tartrate, oleate, tannate, pantothenate, bitartrate, ascorbate, succinate, maleate, gentisinate, fumarate, gluconate, glucaronate, saccharate, formate, benzoate, glutamate, methanesulfonate, ethanesulfonate, benzenesulfonate, p-toluenesulfonate, camphorsulfonate, pamoate, phenylacetate, trifluoroacetate, acrylate, chlorobenzoate, dinitrobenzoate, hydroxybenzoate, methoxybenzoate, methylbenzoate, o-acetoxybenzoate, naphthalene-2-benzoate, isobutyrate, phenylbutyrate, α-hydroxybutyrate, butyne-1,4-dicarboxylate, hexyne-1,4-dicarboxylate, caprate, caprylate, cinnamate, glycollate, heptanoate, hippurate, malate, hydroxymaleate, malonate, mandelate, mesylate, nicotinate, phthalate, teraphthalate, propiolate, propionate, phenylpropionate, sebacate, suberate, p-bromobenzenesulfonate, chlorobenzenesulfonate, ethylsulfonate, 2-hydroxyethylsulfonate, methylsulfonate, naphthalene-1-sulfonate, naphthalene-2-sulfonate, naphthalene-1,5-sulfonate, xylenesulfonate, tartarate salts, hydroxides of alkali metals such as sodium, potassium, and lithium; hydroxides of alkaline earth metal such as calcium and magnesium; hydroxides of other metals, such as aluminum and zinc; ammonia, and organic amines, such as unsubstituted or hydroxy-substituted mono-, di-, or tri-alkylamines, dicyclohexylamine; tributyl amine; pyridine; N-methyl, N-ethylamine; diethylamine; triethylamine; mono-, bis-, or tris-(2-OH-lower alkylamines), such as mono-; bis-, or tris-(2-hydroxyethyl)amine, 2-hydroxy-tert-butylamine, or tris-(hydroxymethyl)methylamine, N,N-di-lower alkyl-N-(hydroxyl-lower alkyl)-amines, such as N,N-dimethyl-N-(2-hydroxyethyl)amine or tri-(2-hydroxyethyl)amine; N-methyl-D-glucamine; and amino acids such as arginine, lysine, and the like.

The present pharmaceutical compositions can comprises excipients, including liquids such as water and oils, including those of petroleum, animal, vegetable, or synthetic origin, such as peanut oil, soybean oil, mineral oil, sesame oil and the like. The pharmaceutical excipients can be, for example, saline, gum acacia, gelatin, starch paste, talc, keratin, colloidal silica, urea and the like. In addition, auxiliary, stabilizing, thickening, lubricating, and coloring agents can be used. In one embodiment, the pharmaceutically acceptable excipients are sterile when administered to a subject. Suitable pharmaceutical excipients also include starch, glucose, lactose, sucrose, gelatin, malt, rice, flour, chalk, silica gel, sodium stearate, glycerol monostearate, talc, sodium chloride, dried skim milk, glycerol, propylene, glycol, water, ethanol and the like. Any agent described herein, if desired, can also comprise minor amounts of wetting or emulsifying agents, or pH buffering agents.

In various embodiments, the compositions described herein can administered in an effective dose of, for example, from about 1 mg/kg to about 100 mg/kg, about 2.5 mg/kg to about 50 mg/kg, or about 5 mg/kg to about 25 mg/kg. The precise determination of what would be considered an effective dose may be based on factors individual to each patient, including their size, age, and type of disease. Dosages can be readily ascertained by those of ordinary skill in the art from this disclosure and the knowledge in the art. For example, doses may be determined with reference *Physicians' Desk Reference*, 66th Edition, PDR Network; 2012 Edition (Dec. 27, 2011), the contents of which are incorporated by reference in its entirety.

The active compositions of the present invention may include classic pharmaceutical preparations. Administration of these compositions according to the present invention may be via any common route so long as the target tissue is available via that route. This includes oral, nasal, or buccal. Alternatively, administration may be by intradermal, subcutaneous, intramuscular, intraperitoneal or intravenous injection, or by direct injection into cancer tissue. The agents disclosed herein may also be administered by catheter systems. Such compositions would normally be administered as pharmaceutically acceptable compositions as described herein.

Upon formulation, solutions may be administered in a manner compatible with the dosage formulation and in such amount as is therapeutically effective. The formulations may easily be administered in a variety of dosage forms such as injectable solutions, drug release capsules and the like. For parenteral administration in an aqueous solution, for example, the solution generally is suitably buffered and the liquid diluent first rendered isotonic with, for example, sufficient saline or glucose. Such aqueous solutions may be used, for example, for intravenous, intramuscular, subcutaneous and intraperitoneal administration. Preferably, sterile aqueous media are employed as is known to those of skill in the art, particularly in light of the present disclosure.

Exemplary subjects or patients refers to any vertebrate including, without limitation, humans and other primates (e.g., chimpanzees and other apes and monkey species), farm animals (e.g., cattle, sheep, pigs, goats, and horses), domestic mammals (e.g., dogs and cats), laboratory animals (e.g., rodents such as mice, rats, and guinea pigs), and birds (e.g., domestic, wild and game birds such as chickens, turkeys and other gallinaceous birds, ducks, geese, and the like). In some embodiments, the subject is a mammal. In some embodiments, the subject is a human.

Administration of the compositions described herein may be, for example, by injection, topical administration, ophthalmic administration and intranasal administration. The injection may include injections such as, but not limited to, intradermal, subcutaneous and intramuscular. The injection, in some embodiments, may be linked to an electrical force (e.g. electroporation, including with devices that find use in electrochemotherapy (e.g. CLINIPORATOR, IGEA Srl, Carpi [MO], Italy)). The topical administration may be, but is not limited to, a cream, lotion, ointment, gel, spray, solution and the like. The topical administration may further include a penetration enhancer such as, but not limited to, surfactants, fatty acids, bile salts, chelating agents, non-chelating non-surfactants, polyoxyethylene-9-lauryl ether, polyoxyethylene-20-cetyl ether, fatty acids and/or salts in combination with bile acids and/or salts, sodium salt in combination with lauric acid, capric acid and UDCA, and the like. The topical administration may also include a fragrance, a colorant, a sunscreen, an antibacterial and/or a moisturizer. The compositions described herein may be administered to at least one site such as, but not limited to, forehead, scalp, hair follicles, hair, upper eyelids, lower eyelids, eyebrows, eyelashes, infraorbital area, periorbital areas, temple, nose, nose bridge, cheeks, tongue, nasolabial folds, lips, periobicular areas, jaw line, ears, neck, breast, forearm, upper arm, palm, hand, finger, nails, back, abdomen, sides, buttocks, thigh, calf, feet, toes and the like.

| Sequences | |
|---|---|
| SEQ ID NO | Description |
| 1 | StsI |
| 2 | StsI-HA |
| 3 | StsI-HA2 |
| 4 | StsI-UHA |
| 5 | StsI-UHA2 |
| 6 | StsI-HF |
| 7 | StsI-UHF |
| 8 | Oct4 |
| 9 | Sox2 |
| 10 | Klf4 |
| 11 | c-Myc |
| 12 | BIRC5_exon1 |
| 13 | BIRC5_exon2 |
| 14 | BIRC5_exon3 |
| 15 | BIRC5_exon4 |
| 16 | BIRC5-1.1-L |
| 17 | BIRC5-1.1-R |
| 18 | BIRC5-1.2-L |
| 19 | BIRC5-1.2-R |
| 20 | BIRC5-1.3-L |
| 21 | BIRC5-1.3-R |
| 22 | BIRC5-2.1-L |
| 23 | BIRC5-2.1-R |
| 24 | BIRC5-2.2-L |
| 25 | BIRC5-2.2-R |
| 26 | BIRC5-3.1-L |

Sequences

| SEQ ID NO | Description |
|---|---|
| 27 | BIRC5-3.1-R |
| 28 | CDK1 |
| 29 | CDK2 |
| 30 | CDK3 |
| 31 | CDK4 |
| 32 | CDK5 |
| 33 | CDK6 |
| 34 | BIRC5 |
| 35 | HIF1A |
| 36 | RRM2 |
| 37 | KRAS |
| 38 | EGFR |
| 39 | MYC |
| 40 | PKN3 |
| 41 | KIF11 |
| 42 | APC |
| 43 | BRCA1 |
| 44 | BRCA2 |
| 45 | TP53 |
| 46 | APP |
| 47 | HTT |
| 48 | IAPP |
| 49 | MAPT |
| 50 | PRNP |
| 51 | SNCA |
| 52 | SOD1 |
| 53 | FokI |
| 54 | Repeat1 |
| 55 | Repeat2 |
| 56 | Repeat3 |
| 57 | EO-GHGG-FokI |
| 58 | GHGG-FokI |
| 59 | EO-GHGG-StsI |
| 60 | GHGG-StsI |
| 61 | collagen alpha-1(I) chain preproprotein |
| 62 | collagen alpha-2(I) chain precursor |
| 63 | collagen alpha-1(II) chain isoform 1 precursor |
| 64 | collagen alpha-1(II) chain isoform 2 precursor |
| 65 | collagen alpha-1(III) chain preproprotein |
| 66 | collagen alpha-1(IV) chain preproprotein |
| 67 | collagen alpha-2(IV) chain preproprotein |
| 68 | collagen alpha-3(IV) chain precursor |
| 69 | collagen alpha-4(IV) chain precursor |
| 70 | collagen alpha-5(IV) chain isoform 1 precursor |
| 71 | collagen alpha-6(IV) chain isoform A precursor |
| 72 | collagen alpha-1(V) chain isoform 1 preproprotein |
| 73 | collagen alpha-2(V) chain preproprotein |
| 74 | collagen alpha-3(V) chain preproprotein |
| 75 | collagen alpha-1(VI) chain precursor |
| 76 | collagen alpha-2(VI) chain isoform 2C2 precursor |
| 77 | collagen alpha-3(VI) chain isoform 1 precursor |
| 78 | collagen alpha-1(VII) chain precursor |
| 79 | elastin isoform a precursor |
| 80 | elastin isoform b precursor |
| 81 | elastin isoform c precursor |
| 82 | elastin isoform d precursor |
| 83 | elastin isoform e precursor |
| 84 | elastin isoform f precursor |
| 85 | elastin isoform g precursor |
| 86 | elastin isoform h precursor |
| 87 | elastin isoform i precursor |
| 88 | elastin isoform j precursor |
| 89 | elastin isoform k precursor |
| 90 | elastin isoform l precursor |
| 91 | elastin isoform m precursor |
| 92 | protein-lysine 6-oxidase isoform 1 preproprotein |
| 93 | protein-lysine 6-oxidase isoform 2 |
| 94 | telomerase reverse transcriptase isoform 1 |
| 95 | telomerase reverse transcriptase isoform 2 |
| 96 | fibronectin isoform 1 preproprotein |
| 97 | fibronectin isoform 3 preproprotein |
| 98 | fibronectin isoform 4 preproprotein |
| 99 | fibronectin isoform 5 preproprotein |
| 100 | fibronectin isoform 6 preproprotein |
| 101 | fibronectin isoform 7 preproprotein |
| 102 | vitronectin precursor |
| 103 | nidogen-1 precursor |
| 104 | laminin subunit alpha-1 precursor |
| 105 | insulin-like growth factor I isoform 1 preproprotein |
| 106 | fibroblast growth factor 1 isoform 1 precursor |
| 107 | fibroblast growth factor 2 |
| 108 | transforming growth factor beta-1 precursor |
| 109 | transforming growth factor beta-2 isoform 1 precursor |
| 110 | transforming growth factor beta-2 isoform 2 precursor |
| 111 | actin, alpha skeletal muscle |
| 112 | actin, aortic smooth muscle |
| 113 | actin, cytoplasmic 1 |
| 114 | actin, alpha cardiac muscle 1 proprotein |
| 115 | actin, cytoplasmic 2 |
| 116 | actin, gamma-enteric smooth muscle isoform 1 precursor |
| 117 | actin, gamma-enteric smooth muscle isoform 2 precursor |
| 118 | granulocyte colony-stimulating factor isoform a precursor |
| 119 | granulocyte colony-stimulating factor isoform b precursor |
| 120 | granulocyte colony-stimulating factor isoform c precursor |
| 121 | granulocyte colony-stimulating factor isoform d precursor |
| 122 | platelet-derived growth factor subunit A isoform 1 preproprotein |
| 123 | platelet-derived growth factor subunit A isoform 2 preproprotein |
| 124 | platelet-derived growth factor subunit B isoform 1 preproprotein |
| 125 | platelet-derived growth factor subunit B isoform 2 preproprotein |
| 126 | platelet-derived growth factor C precursor |
| 127 | platelet-derived growth factor D isoform 1 precursor |
| 128 | platelet-derived growth factor D isoform 2 precursor |
| 129 | interstitial collagenase isoform 1 preproprotein |
| 130 | interstitial collagenase isoform 2 |
| 131 | neutrophil collagenase preproprotein |
| 132 | stromelysin-2 preproprotein |
| 133 | macrophage metalloelastase preproprotein |
| 134 | fibrillin-1 precursor |
| 135 | fibrillin-2 precursor |
| 136 | lysyl oxidase homolog 1 preproprotein |
| 137 | lysyl oxidase homolog 2 precursor |
| 138 | lysyl oxidase homolog 3 isoform 1 precursor |
| 139 | lysyl oxidase homolog 3 isoform 2 precursor |
| 140 | lysyl oxidase homolog 3 isoform 3 |
| 141 | lysyl oxidase homolog 4 precursor |
| 142 | microfibrillar-associated protein 2 isoform a precursor |
| 143 | microfibrillar-associated protein 2 isoform b precursor |
| 144 | microfibrillar-associated protein 5 precursor |
| 145 | disintegrin and metalloproteinase domain-containing protein 17 preprotein |
| 146 | desmoglein-2 preproprotein |
| 147 | DNA polymerase eta isoform 1 |
| 148 | DNA polymerase eta isoform 2 |
| 149 | DNA polymerase eta isoform 3 |
| 150 | ferrochelatase, mitochondrial isoform a precursor |
| 151 | ferrochelatase, mitochondrial isoform b precursor |
| 152 | filaggrin |
| 153 | hyaluronan synthase 1 isoform 1 |
| 154 | hyaluronan synthase 1 isoform 2 |
| 155 | hyaluronan synthase 2 |
| 156 | hyaluronan synthase 3 isoform a |
| 157 | hyaluronan synthase 3 isoform b |
| 158 | proopiomelanocortin |
| 159 | plakophilin-1 isoform 1a |
| 160 | plakophilin-1 isoform 1b |
| 161 | retinol dehydrogenase 10 |
| 162 | mitochondrial brown fat uncoupling protein 1 |
| 163 | tyrosinase precursor |

This invention is further illustrated by the following non-limiting examples.

EXAMPLES

Example 1 RNA Synthesis

RNA encoding green fluorescent protein or the human proteins Elastin, Tyrosinase, Melanocortin 1 receptor, Hyaluronan synthase 1, Hyaluronan synthase 2, Hyaluronan synthase 3, Collagen type III a1, Collagen type VII a1, Interleukin 10, P-selectin glycoprotein ligand-1, Alpha-(1, 3)-fucosyltransferase Oct4, Sox2, Klf4, c-Myc-2 (T58A), and Lin28 or TALENs targeting the human genes XPA, CCR5, TERT, MYC, and BIRC5, and comprising various combinations of canonical and non-canonical nucleotides, was synthesized from DNA templates using the T7 High Yield RNA Synthesis Kit and the Vaccinia Capping System kit with mRNA Cap 2'-O-Methyltransferase (all from New England Biolabs, Inc.), according to the manufacturer's instructions and the present inventors' previously disclosed inventions (U.S. application Ser. No. 13/465,490 (now U.S. Pat. No. 8,497,124), International Application No. PCT/US12/67966, U.S. application Ser. No. 13/931,251, and International Application No. PCT/US13/68118, the contents of all of which are hereby incorporated by reference in their entirety) (Table 4). The RNA was then diluted with nuclease-free water to between 100 ng/μL and 1000 ng/μL. For certain experiments, an RNase inhibitor (Superase•In, Life Technologies Corporation) was added at a concentration of 1 μL/100 μg of RNA. RNA solutions were stored at 4 C. For reprogramming experiments, RNA encoding Oct4, Sox2, Klf4, c-Myc-2 (T58A), and Lin28 was mixed at a molar ratio of 3:1:1:1:1.

TABLE 4

RNA Synthesis

| Template | Nucleotides | Reaction Volume/μL | ivT Yield/μg |
|---|---|---|---|
| hELN | A, 0.5 7dG, 0.4 5mU, 5mC | 20 | 34.1 |
| Oct4 (SEQ ID NO: 8) | A, 0.57 dG, 0.4 5mU, 5mC | 300 | 2752.0 |
| Sox2 (SEQ ID NO: 9) | A, 0.5 7dG, 0.4 5mU, 5mC | 100 | 965.0 |
| Klf4 (SEQ ID NO: 10) | A, 0.5 7dG, 0.4 5mU, 5mC | 100 | 1093.8 |
| c-Myc-2 (T58A) | A, 0.5 7dG, 0.4 5mU, 5mC | 100 | 1265.6 |
| Lin28 | A, 0.5 7dG, 0.4 5mU, 5mC | 100 | 1197.8 |
| ELN | A, G, U, 5hmC | 20 | 67.6 |
| GFP | A, 0.5 7dG, 0.4 5mU, 5mC | 10 | 60.5 |
| GFP | A, 0.5 7dG, 0.4 5mU, 5hmC | 10 | 25.5 |
| GFP | A, G, U, 5hmC | 10 | 58.3 |
| GFP | A, 0.5 7dG, U, 5hmC | 10 | 47.3 |
| GFP | A, 0.5 7dG, 0.4 5mU, 5cC | 10 | 33.8 |
| GFP | A, G, U, 5hmC | 15 | 30.3 |
| GFP | A, G, U, 5hmC | 15 | 44.6 |
| GFP | A, G, U, 5hmC | 15 | 24.7 |
| TYR | A, G, U, 5hmC | 15 | 45.4 |
| MC1R | A, G, U, 5hmC | 15 | 47.5 |
| TYR | A, G, U, C | 20 | 67.0 |
| TYR | A, G, psU, C | 20 | 93.7 |
| TYR | A, G, 5mU, C | 20 | 85.7 |
| TYR | A, G, U, 5mC | 20 | 73.4 |
| TYR | A, G, U, 5hmC | 20 | 72.7 |
| TYR | A, 0.5 7dG, U, C | 20 | 62.7 |
| TYR | A, G, psU, 5mC | 20 | 116.3 |
| TYR | A, G, psU, 5hmC | 20 | 102.4 |
| TYR | A, 0.5 7dG, psU, C | 20 | 87.3 |
| TYR | A, G, 0.4 5mU, 5mC | 20 | 106.5 |
| TYR | A, G, 0.4 5mU, 5hmC | 20 | 85.0 |
| TYR | A, 0.5 7dG, 0.4 5mU, C | 20 | 70.9 |
| TYR | A, 0.5 7dG, U, 5mC | 20 | 88.5 |
| TYR | A, 0.5 7dG, U, 5hmC | 20 | 59.1 |
| TYR | A, 0.5 7dG, psU, 5mC | 20 | 7.8 |
| TYR | A, 0.5 7dG, psU, 5hmC | 20 | 98.0 |
| TYR | A, 0.5 7dG, 0.4 5mU, 5mC | 20 | 106.5 |
| TYR | A, 0.5 7dG, 0.4 5mU, 5hmC | 20 | 82.3 |
| HAS1 | A, G, 0.4 5mU, 5hmC | 20 | 178.4 |
| HAS2 | A, G, 0.4 5mU, 5hmC | 20 | 59.3 |
| HAS3 | A, G, 0.4 5mU, 5hmC | 20 | 102.6 |
| TYR | A, G, 0.4 5mU, 5hmC | 100 | 377.3 |
| COL3A1 | A, G, 0.4 5mU, 5hmC | 20 | 108.3 |
| COL7A1 | A, G, 0.4 5mU, 5hmC | 20 | 94.6 |
| IL10 | A, G, psU, C | 75 | 569.5 |
| SELPLG | A, G, psU, C | 75 | 542.6 |
| FUT7 | A, G, psU, C | 75 | 564.5 |
| Oct4 (SEQ ID NO: 8) | A, G, U, C | 10 | 100.7 |
| Oct4 (SEQ ID NO: 8) | A, G, U, 5mC | 10 | 120.6 |
| Oct4 (SEQ ID NO: 8) | A, G, U, 5mC | 10 | 115.3 |
| Oct4 (SEQ ID NO: 8) | A, G, U, 5hmC | 10 | 101.4 |
| Oct4 (SEQ ID NO: 8) | A, G, U, 5cC | 10 | 50.8 |
| Oct4 (SEQ ID NO: 8) | A, G, U, 5fC | 10 | 84.0 |
| Oct4 (SEQ ID NO: 8) | A, G, U, 5hmC | 10 | 99.5 |
| Sox2 (SEQ ID NO: 9) | A, G, U, 5hmC | 10 | 84.0 |
| Klf4 (SEQ ID NO: 10) | A, G, U, 5hmC | 10 | 72.6 |
| c-Myc-2 (T58A) | A, G, U, 5hmC | 10 | 82.4 |
| Lin28 | A, G, U, 5hmC | 10 | 83.1 |
| Oct4 (SEQ ID NO: 8) | A, G, 0.4 5mU, 5hmC | 10 | 78.9 |
| Sox2 (SEQ ID NO: 9) | A, G, 0.4 5mU, 5hmC | 10 | 91.9 |
| Klf4 (SEQ ID NO: 10) | A, G, 0.4 5mU, 5hmC | 10 | 91.2 |
| c-Myc-2 (T58A) | A, G, 0.4 5mU, 5hmC | 10 | 104.6 |
| Lin28 | A, G, 0.4 5mU, 5hmC | 10 | 103.2 |
| Oct4 (SEQ ID NO: 8) | A, G, 5hU, 5hmC | 300 | 1925.5 |
| Sox2 (SEQ ID NO: 9) | A, G, 5hU, 5hmC | 100 | 641.8 |
| Klf4 (SEQ ID NO: 10) | A, G, 5hU, 5hmC | 100 | 739.0 |
| c-Myc-2 (T58A) | A, G, 5hU, 5hmC | 100 | 574.0 |
| Lin28 | A, G, 5hU, 5hmC | 100 | 556.0 |

"A" refers to adenosine-5'-triphosphate, "G" refers to guanosine-5'-triphosphate, "U" refers to uridine-5'-triphosphate, "C" refers to cytidine-5'-triphosphate, "5mC" refers to 5-methylcytidine-5'-triphosphate, "5hmC" refers to 5-hydroxymethylcytidine-5'-triphosphate, "5cC" refers to 5-carboxycytidine-5'-triphosphate, "5fC" refers to 5-formylcytidine-5'-triphosphate, "psU" refers to 5-pseudouridine-5'-triphosphate, "5mU" refers to 5-methyluridine-5'-triphosphate, "5hU" refers to the 5'-triphosphate of uridine with a methyl group bound to an oxygen atom bound to the 5C position of the uridine, and "7dG" refers to 7-deazaguanosine-5'-triphosphate.

Example 2 Transfection of Cells with Synthetic RNA

For transfection in 6-well plates, 2 μg RNA and 6 μL transfection reagent (Lipofectamine RNAiMAX, Life Technologies Corporation) were first diluted separately in complexation medium (Opti-MEM, Life Technologies Corporation or DMEM/F12+10 μg/mL insulin+5.5 μg/mL transferrin+6.7 ng/mL sodium selenite+2 µg/mL ethanolamine) to a total volume of 60 µL each. Diluted RNA and transfection reagent were then mixed and incubated for 15 min at room temperature, according to the transfection reagent-manufacturer's instructions. Complexes were then added to cells in culture. Between 12 µL and 240 µL of complexes were added to each well of a 6-well plate, which already contained 2 mL of transfection medium per well. Plates were shaken gently to distribute the complexes throughout the well. Cells were incubated with complexes for 4 hours to overnight, before replacing the medium with fresh transfection medium (2 mL/well). Volumes were scaled for transfection in 24-well and 96-well plates. Alternatively, between 0.5 µg and 5 µg of RNA and between 2-3 µL of transfection reagent (Lipofectamine 2000, Life Technologies Corporation) per µg of RNA were first diluted separately in complexation medium (Opti-MEM, Life Technologies Corporation or DMEM/F12+10 µg/mL insulin+5.5 µg/mL transferrin+6.7 ng/mL sodium selenite+2 µg/mL ethanolamine) to a total volume of between 5 µL and 100 µL each. Diluted RNA and transfection reagent were then mixed and incubated for 10 min at room temperature. Complexes were then added to cells in culture. Between 10 µL and 200 µL of complexes were added to each well of a 6-well plate, which already contained 2 mL of transfection medium per well. In certain experiments, DMEM+10% FBS or DMEM+50% FBS was used in place of transfection medium. Plates were shaken gently to distribute the complexes throughout the well. Cells were incubated with complexes for 4 hours to overnight. In certain experiments, the medium was replaced with fresh transfection medium (2 mL/well) 4 h or 24 h after transfection.

Example 3 Toxicity of and Protein Translation from Synthetic RNA Containing Non-Canonical Nucleotides Primary human fibroblasts were transfected according to Example 2, using RNA synthesized according to Example 1. Cells were fixed and stained 20-24 h after transfection using an antibody against Oct4. The relative toxicity of the RNA was determined by assessing cell density at the time of fixation.

Example 4 Transfection Medium Formulation

A cell-culture medium was developed to support efficient transfection of cells with nucleic acids and efficient reprogramming ("transfection medium"):
DMEM/F12+15 mM HEPES+2 mM L-alanyl-L-glutamine+10 µg/mL insulin+5.5 µg/mL transferrin+6.7 ng/mL sodium selenite+2 µg/mL ethanolamine+50 µg/mL L-ascorbic acid 2-phosphate sesquimagnesium salt hydrate+4 µg/mL cholesterol+1 µM hydrocortisone+25 µg/mL polyoxyethylenesorbitan monooleate+2 µg/mL D-alpha-tocopherol acetate+20 ng/mL bFGF+5 mg/mL treated human serum albumin.
A variant of this medium was developed to support robust, long-term culture of a variety of cell types, including pluripotent stem cells ("maintenance medium"):
DMEM/F12+2 mM L-alanyl-L-glutamine+10 µg/mL insulin+5.5 µg/mL transferrin+6.7 ng/mL sodium selenite+2 µg/mL ethanolamine+50 µg/mL L-ascorbic acid 2-phosphate sesquimagnesium salt hydrate+20 ng/mL bFGF+2 ng/mL TGF-31.
Transfection medium, in which the treated human serum albumin was treated by addition of 32 mM sodium octanoate, followed by heating at 60C for 4 h, followed by treatment with ion-exchange resin (AG501-X8(D), Bio-Rad Laboratories, Inc.) for 6 h at room temperature, followed by treatment with dextran-coated activated charcoal (C6241, Sigma-Aldrich Co. LLC.) overnight at room temperature, followed by centrifugation, filtering, adjustment to a 10% solution with nuclease-free water, followed by addition to the other components of the medium, was used as the transfection medium in all Examples described herein, unless otherwise noted. For reprogramming experiments, cells were plated either on uncoated plates in DMEM+10%-20% serum or on fibronectin and vitronectin-coated plates in transfection medium, unless otherwise noted. The transfection medium was not conditioned, unless otherwise noted. It is recognized that the formulation of the transfection medium can be adjusted to meet the needs of the specific cell types being cultured. It is further recognized that treated human serum albumin can be replaced with other treated albumin, for example, treated bovine serum albumin, without negatively affecting the performance of the medium. It is further recognized that other glutamine sources can be used instead of or in addition to L-alanyl-L-glutamine, for example, L-glutamine, that other buffering systems can be used instead of or in addition to HEPES, for example, phosphate, bicarbonate, etc., that selenium can be provided in other forms instead of or in addition to sodium selenite, for example, selenous acid, that other antioxidants can be used instead of or in addition to L-ascorbic acid 2-phosphate sesquimagnesium salt hydrate and/or D-alpha-tocopherol acetate, for example, L-ascorbic acid, that other surfactants can be used instead of or in addition to polyoxyethylene-sorbitan monooleate, for example, Pluronic F-68 and/or Pluronic F-127, that other basal media can be used instead of or in addition to DMEM/F12, for example, MEM, DMEM, etc., and that the components of the culture medium can be varied with time, for example, by using a medium without TGF-β from day 0 to day 5, and then using a medium containing 2 ng/mL TGF-β after day 5, without negatively affecting the performance of the medium. It is further recognized that other ingredients can be added, for example, fatty acids, lysophosphatidic acid, lysosphingomyelin, sphingosine-1-phosphate, other sphingolipids, ROCK inhibitors, including Y-27632 and thiazovivin, members of the TGF-β/NODAL family of proteins, IL-6, members of the Wnt family of proteins, etc., at appropriate concentrations, without negatively affecting the performance of the medium, and that ingredients that are known to promote or inhibit the growth of specific cell types and/or agonists and/or antagonists of proteins or other molecules that are known to promote or inhibit the growth of specific cell types can be added to the medium at appropriate concentrations when it is used with those cell types without negatively affecting the performance of the medium, for example, sphingosine-1-phosphate and pluripotent stem cells. The present invention relates equally to ingredients that are added as purified compounds, to ingredients that are added as parts of well-defined mixtures, to ingredients that are added as parts of complex or undefined mixtures, for example, animal or plant oils, and to ingredients that are added by biological processes, for example, conditioning. The concentrations of the components can be varied from the listed values within ranges that will be obvious to persons skilled in the art without negatively affecting the performance of the medium. An animal component-free version of the medium was produced by using recombinant versions of all protein ingredients, and non-animal-derived versions of all other components, including semi-synthetic plant-derived cholesterol (Avanti Polar Lipids, Inc.).

Example 5 Transfection Medium Formulation

A medium was developed to support efficient transfection, reprogramming, and gene-editing of cells:
DMEM/F12+10 µg/mL insulin+5.5 µg/mL transferrin+6.7 ng/mL sodium selenite+20 ng/mL bFGF+5 mg/mL treated human serum albumin.

Variants of this medium were also developed to provide improved performance when used with specific transfection reagents, specific nucleic acids, and specific cell types: DMEM/F12+10 µg/mL insulin+5.5 µg/mL transferrin+6.7 ng/mL sodium selenite+4.5 µg/mL cholesterol+20 ng/mL bFGF+5 mg/mL treated human serum albumin, DMEM/F12+10 µg/mL insulin+5.5 µg/mL transferrin+6.7 ng/mL sodium selenite+1 µM hydrocortisone+20 ng/mL bFGF+5 mg/mL treated human serum albumin, and DMEM/F12+10 µg/mL insulin+5.5 µg/mL transferrin+6.7 ng/mL sodium selenite+4.5 µg/mL cholesterol+1 µM hydrocortisone+20 ng/mL bFGF+5 mg/mL treated human serum albumin.

Examples of additional components that were added to the cell-culture medium in certain experiments (listed with example concentrations) include: 15 mM HEPES, 2 mM L-alanyl-L-glutamine, 2 µg/mL ethanolamine, 10 µg/mL fatty acids, 10 µg/mL cod liver oil fatty acids (methyl esters), 25 µg/mL polyoxyethylenesorbitan monooleate, 2 µg/mL D-alpha-tocopherol acetate, 1-50 µg/mL L-ascorbic acid 2-phosphate sesquimagnesium salt hydrate, 200 ng/mL B18R, and 0.1% Pluronic F-68.

For certain experiments in which the medium was conditioned, the following variant was used:
DMEM/F12+15 mM HEPES+2 mM L-alanyl-L-glutamine+10 µg/mL insulin+5.5 µg/mL transferrin+6.7 ng/mL sodium selenite+2 µg/mL ethanolamine+4.5 µg/mL cholesterol+10 µg/mL cod liver oil fatty acids (methyl esters)+25 µg/mL polyoxyethylenesorbitan monooleate+2 µg/mL D-alpha-tocopherol acetate+1 µg/mL L-ascorbic acid 2-phosphate sesquimagnesium salt hydrate+0.1% Pluronic F-68+20 ng/mL bFGF+5 mg/mL treated human serum albumin.

For certain experiments in which the medium was not conditioned, the following variant was used:
DMEM/F12+15 mM HEPES+2 mM L-alanyl-L-glutamine+10 µg/mL insulin+5.5 µg/mL transferrin+6.7 ng/mL sodium selenite+2 µg/mL ethanolamine+4.5 µg/mL cholesterol+1 µM hydrocortisone+0-25 µg/mL polyoxyethylenesorbitan monooleate+2 µg/mL D-alpha-tocopherol acetate+50 µg/mL L-ascorbic acid 2-phosphate sesquimagnesium salt hydrate+20 ng/mL bFGF+5 mg/mL treated human serum albumin.

For the preparation of the these variants, the treated human serum albumin was treated by addition of 32 mM sodium octanoate, followed by heating at 60C for 4 h, followed by treatment with ion-exchange resin (AG501-X8 (D)) for 6 h at room temperature, followed by treatment with dextran-coated activated charcoal (C6241, Sigma-Aldrich Co. LLC.) overnight at room temperature, followed by centrifugation, filtering, adjustment to a 10% solution with nuclease-free water, followed by addition to the other components of the medium. For certain experiments in which the medium was conditioned, the medium was conditioned for 24 h on irradiated human neonatal fibroblast feeders. The cells were plated on fibronectin-coated plates or fibronectin and vitronectin-coated plates, unless otherwise noted.

The formulation of the medium can be adjusted to meet the needs of the specific cell types being cultured. Furthermore, in certain situations, treated human serum albumin can be replaced with other treated albumin, for example, treated bovine serum albumin, other glutamine sources can be used instead of or in addition to L-alanyl-L-glutamine, for example, L-glutamine, other buffering systems can be used instead of or in addition to HEPES, for example, phosphate, bicarbonate, etc., selenium can be provided in other forms instead of or in addition to sodium selenite, for example, selenous acid, other antioxidants can be used instead of or in addition to L-ascorbic acid 2-phosphate sesquimagnesium salt hydrate and/or D-alpha-tocopherol acetate, for example, L-ascorbic acid, other surfactants can be used instead of or in addition to polyoxyethylenesorbitan monooleate and/or Pluronic F-68, for example, Pluronic F-127, other basal media can be used instead of or in addition to DMEM/F12, for example, MEM, DMEM, etc., and the components of the culture medium can be varied with time, for example, by using a medium without TGF-β from day 0 to day 5, and then using a medium containing 2 ng/mL TGF-β after day 5. In certain situations, other ingredients can be added, for example, fatty acids, lysophosphatidic acid, lysosphingomyelin, sphingosine-1-phosphate, other sphingolipids, members of the TGF-β/NODAL family of proteins, IL-6, members of the Wnt family of proteins, etc., at appropriate concentrations, and ingredients that are known to promote or inhibit the growth of specific cell types and/or agonists and/or antagonists of proteins or other molecules that are known to promote or inhibit the growth of specific cell types can be added to the medium at appropriate concentrations when it is used with those cell types, for example, sphingosine-1-phosphate and pluripotent stem cells. Ingredients can take the form of purified compounds, parts of well-defined mixtures, parts of complex or undefined mixtures, for example, animal or plant oils, and may be added by biological processes, for example, conditioning. The concentrations of the components can be varied from the listed values within ranges that will be obvious to persons skilled in the art.

Example 6 Transfection of Cells with Synthetic RNA

For transfection in 6-well plates, 2 µg RNA and 6 µL transfection reagent (Lipofectamine™ RNAiMAX, Life Technologies Corporation) were first diluted separately in complexation medium (Opti-MEM®, Life Technologies Corporation) to a total volume of 60 µL each. Diluted RNA and transfection reagent were then mixed and incubated for 15 min at room temperature, according to the transfection reagent-manufacturer's instructions. Complexes were then added to cells in culture. Between 30 µL and 240 µL of complexes were added to each well of a 6-well plate, which already contained 2 mL of transfection medium per well. Plates were then shaken gently to distribute the complexes throughout the well. Cells were incubated with complexes for 2 hours to overnight, before replacing the medium with fresh transfection medium (2 mL/well). Volumes were scaled for transfection in 24-well and 96-well plates. Cells were fixed and stained 20-24 h after transfection using an antibody against Oct4. Nuclei were stained and counted to determine the relative toxicity of the RNA.

Example 7 Analysis of the Ability of Untreated Human Serum Albumin Preparations to Support Nucleic Acid Transfection and RNA Reprogramming Primary human neonatal fibroblasts were cultured in medium with or without 5 mg/mL HSA. Cohn Fraction V (A6784, Sigma-Aldrich Co. LLC.), and four different recombinant HSA preparations (A6608, A7736, A9731, and A9986, all from Sigma-Aldrich Co. LLC.) were screened. Cells were transfected according to Example 2, with RNA synthesized according to Example 1. While untransfected cells grew well in media containing any of the HSA preparations, in transfected wells, each of the HSA preparations yielded dramatically different cell morphologies and cell densities, and none resulted in morphological changes indicative of reprogramming.

Example 8 Production of Octanoate-Treated Human Serum Albumin

A 10% solution of HSA was pre-incubated with 22 mM sodium chloride and 16 mM sodium octanoate (Sigma-Aldrich Co. LLC), and was incubated at 37 C for 3 hours before assembly of the complete medium.

Example 9 Treatment of Human Serum Albumin Using Ion-Exchange Chromatography

A 20% solution of recombinant HSA produced in *Pichia pastoris* (A7736, Sigma-Aldrich Co. LLC.) was prepared by dissolving 2 g of HSA in 10 mL of nuclease-free water with gentle agitation at room temperature. The HSA solution was then deionized by first adding 1 g of mixed-bed deionizing resin (AG 501-X8(D), Bio-Rad Laboratories, Inc.), and rocking for 1 h at room temperature. The HSA solution was then decanted into a tube containing 5 g of fresh resin, and was rocked for 4 h at room temperature. Finally, the deionized HSA solution was decanted, adjusted to a 10% total protein content with nuclease-free water, filter-sterilized using a 0.2 μm PES-membrane filter, and stored at 4 C.

Example 10 Analysis of Transfection Efficiency and Viability of Cells Cultured in Media Containing Octanoate-Treated Human Serum Albumin Primary human neonatal fibroblasts were cultured in media containing recombinant HSA treated according to Example 8 and/or Example 9 or containing treated blood-derived HSA (Bio-Pure HSA, Biological Industries). Cells were transfected daily, according to Example 2, with RNA synthesized according to Example 1, beginning on day 0. Pictures were taken on day 3. Several small areas of cells undergoing morphological changes resembling mesenchymal to epithelial transition were observed in the wells containing octanoate, indicating an increased transfection efficiency. Many large areas of morphological changes resembling mesenchymal to epithelial transition were observed in the samples containing the treated blood-derived HSA. In both cases, the morphological changes were characteristic of reprogramming.

Example 11 Reprogramming Human Fibroblasts Using Media Containing Octanoate-Treated Human Serum Albumin Primary human neonatal fibroblasts were plated in 6-well plates at a density of 5000 cells/well in fibroblast medium (DMEM+10% fetal bovine serum). After 6 hours, the medium was replaced with transfection medium containing octanoate-treated HSA. The cells were transfected daily, according to Example 2, with RNA synthesized according to Example 1, beginning on day 0. By day 5, the well contained several areas of cells exhibiting morphology consistent with reprogramming. This experiment did not include the use of feeders or immunosuppressants.

Example 12 Analysis of Transfection Efficiency and Viability of Cells Cultured in Media Containing Ion-Exchange-Resin-Treated Human Serum Albumin Primary human neonatal fibroblasts were transfected according to Example 2, with RNA synthesized according to Example 1, beginning on day 0. Pictures were taken on day 2. Cells in the well containing untreated HSA exhibited low viability compared to either the well containing treated blood-derived HSA or ion-exchange-resin-treated recombinant HSA.

Example 13 Reprogramming Human Fibroblasts Using Ion-Exchange-Resin-Treated Human Serum Albumin Primary human neonatal fibroblasts were plated in 6-well plates on feeders at a density of 10,000 cells/well in fibroblast medium (DMEM+10% fetal bovine serum). The cells were transfected daily according to Example 2, with RNA synthesized according to Example 1, beginning on day 0. A passage with a split ratio of 1:20 was performed on day 4. Pictures were taken on day 10. The well contained many large colonies of cells exhibiting morphology consistent with reprogramming. No colonies were observed in wells exposed to cell-culture media containing untreated HSA.

Example 14 Reprogramming Human Fibroblasts without Using Feeders or Immunosuppressants Primary human fibroblasts were plated in 6-well plates at a density of 20,000 cells/well in fibroblast medium (DMEM+10% fetal bovine serum). After 6 hours, the medium was replaced with transfection medium containing treated HSA and not containing immunosuppressants, and the cells were transfected daily according to Example 2, with RNA synthesized according to Example 1, except that the dose of RNA was reduced to 1 μg/well and a total of 5 transfections were performed. Pictures were taken on day 7. Small colonies of cells exhibiting morphology consistent with reprogramming became visible as early as day 5. On day 7, the medium was replaced with DMEM/F12+20% Knockout™ Serum Replacement (Life Technologies Corporation)+1× non-essential amino acids+2 mM L-glutamine, conditioned on irradiated mouse embryonic fibroblasts for 24 hours, and then supplemented with 20 ng/mL bFGF and 10 μM Y-27632. Large colonies with a reprogrammed morphology became visible as early as day 8. Colonies were picked on day 10, and plated in wells coated with basement membrane extract (Cultrex® Human BME Pathclear®, Trevigen Inc.). Cells grew rapidly, and were passaged to establish lines. Established lines stained positive for the pluripotent stem-cell markers Oct4 and SSEA4. The entire protocol was repeated, and similar results were obtained.

Example 15 Efficient, Rapid Derivation and Reprogramming of Cells from Human Skin Biopsy Tissue A full-thickness dermal punch biopsy was performed on a healthy, 31 year-old volunteer, according to an approved protocol. Briefly, an area of skin on the left, upper arm was anesthetized by topical application of 2.5% lidocaine. The field was disinfected with 70% isopropanol, and a full-thickness dermal biopsy was performed using a 1.5 mm-diameter punch. The tissue was rinsed in phosphate-buffered saline (PBS), and was placed in a 1.5 mL tube containing 250 µL of TrypLE™ Select CTS™ (Life Technologies Corporation), and incubated at 37 C for 30 min. The tissue was then transferred to a 1.5 mL tube containing 250 µL of DMEM/F12-CTS™ (Life Technologies Corporation)+5 mg/mL collagenase, and incubated at 37 C for 2 h. The epidermis was removed using forceps, and the tissue was mechanically dissociated. Cells were rinsed twice in DMEM/F12-CTS™ and were plated in fibronectin-coated wells of 24-well and 96-well plates. Phlebotomy was also performed on the same volunteer, and venous blood was collected in Vacutainer® SST™ tubes (Becton, Dickinson and Company). Serum was isolated according to the manufacturer's protocol. Isogenic plating medium was prepared by mixing DMEM/F12-CTS™+2 mM L-alanyl-L-glutamine (Sigma-Aldrich Co. LLC.)+20% human serum. Cells from the dermal tissue sample were plated either in transfection medium or in isogenic plating medium. After 2 days, the wells were rinsed, and the medium was replaced with transfection medium. Many cells with a fibroblast morphology attached and began to spread by day 2. Cells were transfected according to Example 2, with RNA synthesized according to Example 1, beginning on day 2, with all volumes scaled to accommodate the smaller wells. By day 5, areas of cells with morphologies consistent with reprogramming were observed.

Example 16 Reprogramming Human Fibroblasts Using Synthetic RNA Containing Non-Canonical Nucleotides Primary human fibroblasts were plated in 6-well plates coated with recombinant human fibronectin and recombinant human vitronectin (each diluted in DMEM/F12 to a concentration of 1 µg/mL, 1 mL/well, incubated at room temperature for 1 h) at a density of 20,000 cells/well in transfection medium. The following day, the cells were transfected as in Example 2, with RNA synthesized according to Example 1, except that the dose of RNA was 0.5 µg/well on day 1, 0.5 µg/well on day 2, and 2 µg/well on day 3. Pictures were taken on day 4. Small colonies of cells exhibiting morphology consistent with reprogramming were visible on day 4.

Example 17 Reprogramming Human Fibroblasts with a Non-Conditioned Transfection Medium Primary human fibroblasts were plated in 6-well plates coated with recombinant human fibronectin and recombinant human vitronectin (each diluted in DMEM/F12 to a concentration of 1 µg/mL, 1 mL/well, incubated at room temperature for 1 h) at a density of 20,000 cells/well in transfection medium. The following day, the cells were transfected as in Example 2, with RNA synthesized according to Example 1, except that the dose of RNA was 0.5 µg/well on day 1, 0.5 µg/well on day 2, 2 µg/well on day 3, 2 µg/well on day 4, and 4 µg/well on day 5. Small colonies of cells exhibiting morphology consistent with reprogramming became visible as early as day 5. On day 7, the medium was replaced with DMEM/F12+20% Knockout™ Serum Replacement (Life Technologies Corporation)+1× non-essential amino acids+2 mM L-glutamine, conditioned on irradiated mouse embryonic fibroblasts for 24 hours, and then supplemented with 20 ng/mL bFGF and 10 µM Y-27632. Large colonies with a reprogrammed morphology became visible as early as day 8. Colonies were picked on day 10, and plated in wells coated with basement membrane extract (Cultrex® Human BME Pathclear®, Trevigen Inc.). Cells grew rapidly, and were passaged to establish lines.

Example 18 Reprogramming Human Fibroblasts Using Synthetic RNA Containing Non-Canonical Nucleotides Primary human neonatal fibroblasts were plated in 6-well plates coated with recombinant human fibronectin and recombinant human vitronectin (each diluted in DMEM/F12 to a concentration of 1 µg/mL, 1 mL/well, and incubated at room temperature for 1 h) at a density of 10,000 cells/well in transfection medium. The following day, the cells were transfected as in Example 2, using RNA containing A, 0.5 7 dG, 0.5 5 mU, and 5 mC, and an RNA dose of 0.5 µg/well on day 1, 0.5 µg/well on day 2, 2 µg/well on day 3, 2 µg/well on day 4, and 4 µg/well on day 5. Small colonies of cells exhibiting morphology consistent with reprogramming became visible as early as day 5. The medium was replaced with maintenance medium on day 6. Cells were stained using an antibody against Oct4. Oct4-positive colonies of cells exhibiting a morphology consistent with reprogramming were visible throughout the well.

Example 19 Feeder-Free, Passage-Free, Immunosuppressant-Free, Conditioning-Free Reprograming of Primary Adult Human Fibroblasts Using Synthetic RNA Wells of a 6-well plate were coated with a mixture of recombinant human fibronectin and recombinant human vitronectin (1 µg/mL in DMEM/F12, 1 mL/well) for 1 h at room temperature. Primary adult human fibroblasts were plated in the coated wells in transfection medium at a density of 10,000 cells/well. Cells were maintained at 37 C, 5% $CO_2$, and 5% 02. Beginning the following day, cells were transfected according to Example 2 daily for 5 days with RNA synthesized according to Example 1. The total amount of RNA transfected on each of the 5 days was 0.5 µg, 0.5 µg, 2 µg, 2 µg, and 4 µg, respectively. Beginning with the fourth transfection, the medium was replaced twice a day. On the day following the final transfection, the medium was replaced with transfection medium, supplemented with 10 µM Y-27632. Alternatively, the total amount of RNA transfected on each day was 0.25 µg, 0, 0.5 µg, 0.5 µg, and 0.5 µg, respectively or 0.25 µg, 0, 0.25 µg, 0.25 µg, 0.25 µg, and 0.25 µg, respectively. In certain experiments, transfection medium was changed only once per day, at the time of transfection. Compact colonies of cells with a reprogrammed morphology were visible in each transfected well by day 4.

Example 20 Efficient, Rapid Derivation and Reprogramming of Cells from Adult Human Skin Biopsy Tissue A full-thickness dermal punch biopsy was performed on a healthy, 31 year-old volunteer, according to an approved protocol. Briefly, an area of skin on the left, upper arm was anesthetized by topical application of 2.5% lidocaine. The field was disinfected with 70% isopropanol, and a full-thickness dermal biopsy was performed using a 1.5 mm-diameter punch. The tissue was rinsed in phosphate-buffered saline (PBS), was placed in a 1.5 mL tube containing 250 µL of TrypLE Select CTS (Life Technologies Corporation), and was incubated at 37 C for 30 min. The tissue was then transferred to a 1.5 mL tube containing 250 µL of DMEM/F12-CTS (Life Technologies Corporation)+5 mg/mL collagenase, and was incubated at 37 C for 2 h. The epidermis was removed using forceps, and the tissue was mechanically dissociated. Cells were rinsed twice in DMEM/F12-CTS. Phlebotomy was also performed on the same volunteer, and venous blood was collected in Vacutainer SST tubes (Becton, Dickinson and Company). Serum was isolated according to the manufacturer's instructions. Isogenic plating medium was prepared by mixing DMEM/F12-CTS+2 mM L-alanyl-L-glutamine (Sigma-Aldrich Co. LLC.)+20% human serum. Cells from the dermal tissue sample were plated in a fibronectin-coated well of a 6-well plate in isogenic plating medium. Many cells with a fibroblast morphology attached and began to spread by day 2. Cells were expanded and frozen in Synth-a-Freeze (Life Technologies Corporation).

Cells were passaged into 6-well plates at a density of 5,000 cells/well. The following day, the medium was replaced with transfection medium, and the cells were transfected as in Example 2, using RNA containing A, 0.5 7 dG, 0.4 5 mU, and 5 mC, and an RNA dose of 0.5 µg/well on day 1, 0.5 µg/well on day 2, 2 µg/well on day 3, 2 µg/well on day 4, and 2 µg/well on day 5. Certain wells received additional 2 µg/well transfections on day 6 and day 7. In addition, certain wells received 2 ng/mL TGF-β1 from day 4 onward. The medium was replaced with maintenance medium on day 6. Colonies of cells exhibiting morphology consistent with reprogramming became visible between day 5 and day 10. Colonies grew rapidly, and many exhibited a morphology similar to that of embryonic stem-cell colonies. Colonies were picked and plated in wells coated with recombinant human fibronectin and recombinant human vitronectin (each diluted in DMEM/F12 to a concentration of 1 µg/mL, 1 mL/well, incubated at room temperature for 1 h). Cells grew rapidly, and were passaged to establish lines.

Example 21 High-Efficiency Gene Editing by Repeated Transfection with RiboSlice

Primary human fibroblasts were plated as in Example 19. The following day, the cells were transfected as in Example 2 with RNA synthesized according to Example 1. The following day cells in one of the wells were transfected a second time. Two days after the second transfection, the efficiency of gene editing was measured using a mutation-specific nuclease assay.

Example 22 Transfection of Cells with Synthetic RNA Containing Non-Canonical Nucleotides and DNA Encoding a Repair Template For transfection in 6-well plates, 1 µg RNA encoding gene-editing proteins targeting exon 16 of the human APP gene, 1 µg single-stranded repair template DNA containing a PstI restriction site that was not present in the target cells, and 6 µL transfection reagent (Lipofectamine RNAiMAX, Life Technologies Corporation) were first diluted separately in complexation medium (Opti-MEM, Life Technologies Corporation) to a total volume of 120 µL. Diluted RNA, repair template, and transfection reagent were then mixed and incubated for 15 min at room temperature, according to the transfection reagent-manufacturer's instructions. Complexes were added to cells in culture. Approximately 120 µL of complexes were added to each well of a 6-well plate, which already contained 2 mL of transfection medium per well. Plates were shaken gently to distribute the complexes throughout the well. Cells were incubated with complexes for 4 hours to overnight, before replacing the medium with fresh transfection medium (2 mL/well). The next day, the medium was changed to DMEM+10% FBS. Two days after transfection, genomic DNA was isolated and purified. A region within the APP gene was amplified by PCR, and the amplified product was digested with PstI and analyzed by gel electrophoresis.

Example 23 In Vivo RiboSlice Safety Study 40 female NCr nu/nu mice were injected subcutaneously with $5 \times 10^6$ MDA-MB-231 tumor cells in 50% Matrigel (BD Biosciences). Cell injection volume was 0.2 mL/mouse. The age of the mice at the start of the study was 8 to 12 weeks. A pair match was conducted, and animals were divided into 4 groups of 10 animals each when the tumors reached an average size of 100-150 mm$^3$, and treatment was begun. Body weight was measured every day for the first 5 days, and then biweekly to the end of the study. Treatment consisted of RiboSlice BIRC5-1.2 complexed with a vehicle (Lipofectamine 2000, Life Technologies Corporation). To prepare the dosing solution for each group, 308 µL of complexation buffer (Opti-MEM, Life Technologies Corporation) was pipetted into each of two sterile, RNase-free 1.5 mL tubes. 22 µL of RiboSlice BIRC5-1.2 (500 ng/µL) was added to one of the two tubes, and the contents of the tube were mixed by pipetting. 22 µL of vehicle was added to the second tube. The contents of the second tube were mixed, and then transferred to the first tube, and mixed with the contents of the first tube by pipetting to form complexes. Complexes were incubated at room temperature for 10 min. During the incubation, syringes were loaded. Animals were injected either intravenously or intratumorally with a total dose of 1 µg RNA/animal in 60 µL total volume/animal. A total of 5 treatments were given, with injections performed every other day. Doses were not adjusted for body weight. Animals were followed for 17 days. No significant reduction in mean body weight was observed, demonstrating the in vivo safety of RiboSlice gene-editing RNA.

Example 24 Screening of Reagents for Delivery of Nucleic Acids to Cells

Delivery reagents including polyethyleneimine (PEI), various commercial lipid-based transfection reagents, a peptide-based transfection reagent (N-TER, Sigma-Aldrich Co. LLC.), and several lipid-based and sterol-based delivery reagents were screened for transfection efficiency and toxicity in vitro. Delivery reagents were complexed with RiboSlice BIRC5-1.2, and complexes were delivered to HeLa cells in culture. Toxicity was assessed by analyzing cell density 24 h after transfection. Transfection efficiency was assessed by analyzing morphological changes. The tested reagents exhibited a wide range of toxicities and transfection efficiencies. Reagents containing a higher proportion of ester bonds exhibited lower toxicities than reagents containing a lower proportion of ester bonds or no ester bonds.

Example 25 High-Concentration Liposomal RiboSlice

High-Concentration Liposomal RiboSlice was prepared by mixing 1 µg RNA at 500 ng/µL with 3 µL of complexation medium (Opti-MEM, Life Technologies Corporation), and 2.5 µL of transfection reagent (Lipofectamine 2000, Life Technologies Corporation) per µg of RNA with 2.5 µL of complexation medium. Diluted RNA and transfection reagent were then mixed and incubated for 10 min at room temperature to form High-Concentration Liposomal RiboSlice. Alternatively, a transfection reagent containing DOSPA or DOSPER is used.

Example 26 In Vivo RiboSlice Efficacy Study—Subcutaneous Glioma Model 40 female NCr nu/nu mice were injected subcutaneously with $1 \times 10^7$ U-251 tumor cells. Cell injection volume was 0.2 mL/mouse. The age of the mice at the start of the study was 8 to 12 weeks. A pair match was conducted, and animals were divided into 4 groups of 10 animals each when the tumors reached an average size of 35-50 mm$^3$, and treatment was begun. Body weight was measured every day for the first 5 days, and then biweekly to the end of the study. Caliper measurements were made biweekly, and tumor size was calculated. Treatment consisted of RiboSlice BIRC5-2.1 complexed with a vehicle (Lipofectamine 2000, Life Technologies Corporation). To prepare the dosing solution, 294 µL of complexation buffer (Opti-MEM, Life Technologies Corporation) was pipetted into a tube containing 196 µL of RiboSlice BIRC5-1.2 (500 ng/µL), and the contents of the tube were mixed by pipetting. 245 µL of complexation buffer was pipetted into a tube containing 245 µL of vehicle. The contents of the second tube were mixed, and then transferred to the first tube, and mixed with the contents of the first tube by pipetting to form complexes. Complexes were incubated at room temperature for 10 min. During the incubation, syringes were loaded. Animals were injected intratumorally with a total dose of either 2 µg or 5 µg RNA/animal in either 20 µL or 50 µL total volume/animal. A total of 5 treatments were given, with injections performed every other day. Doses were not adjusted for body weight. Animals were followed for 25 days.

Example 27 Liposome Formulation and Nucleic-Acid Encapsulation

Liposomes are prepared using the following formulation: 3.2 mg/mL N-(carbonyl-ethoxypolyethylene glycol 2000)-1,2-distearoyl-sn-glycero-3-phosphoethanolamine (MPEG2000-DSPE), 9.6 mg/mL fully hydrogenated phosphatidylcholine, 3.2 mg/mL cholesterol, 2 mg/mL ammonium sulfate, and histidine as a buffer. pH is controlled using sodium hydroxide and isotonicity is maintained using sucrose. To form liposomes, lipids are mixed in an organic solvent, dried, hydrated with agitation, and sized by extrusion through a polycarbonate filter with a mean pore size of 800 nm. Nucleic acids are encapsulated by combining 10 µg of the liposome formulation per 1 µg of nucleic acid and incubating at room temperature for 5 minutes.

Example 28 Folate-Targeted Liposome Formulation

Liposomes are prepared according to Example 62, except that 0.27 mg/mL 1,2-distearoyl-sn-glycero-3-phosphoethanolamine-N-[folate(polyethylene glycol)-5000] (FA-MPEG5000-DSPE) is added to the lipid mixture.

Example 29 Therapy Comprising Liposomal Protein-Encoding RNA

Liposomes encapsulating synthetic RNA encoding a therapeutic protein, synthesized according to Example 1, are prepared according to Example 27 or Example 28. The liposomes are administered by injection or intravenous infusion.

Example 30 Generation of Elastin ivT-RNA Template

Total RNA was extracted from neonatal human dermal fibroblasts using the RNeasy mini kit (QIAGEN GmbH), according to the manufacturer's instructions. cDNA encoding human elastin was prepared using MonsterScript™ Reverse Transcriptase (Epicentre Biotechnologies) and the primer: AAAAAAACCGGT TCATTTTCTCTTCCGGC-CAC (SED ID NO: 166). An in vitro transcription (ivT) template was prepared from the cDNA by PCR amplification of the elastin coding sequence (CDS) using the primers: F: AAAAAAGCTAGCATGGCGGGTCTGACG (SED ID NO: 167, and R: AAAAAAACCGGTTCATTTTCTCTTC-CGGCCAC (SED ID NO: 168). The PCR product was then purified using agarose gel electrophoresis and the QIAquick Gel Extraction Kit (QIAGEN GmbH) and was cloned into a vector containing the human beta globin (HBB) 5' and 3' untranslated regions and a strong Kozak sequence. The vector was amplified, purified, and linearized prior to RNA synthesis.

Example 31 Synthesis of Elastin RNA

Figure 1:
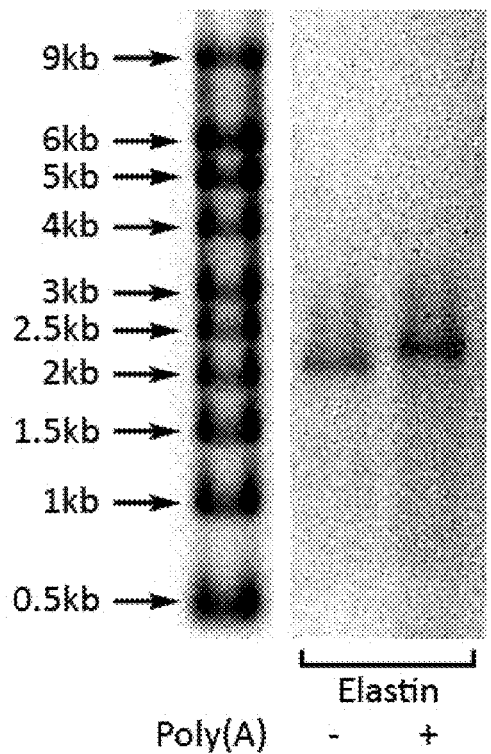
FIG. 1 depicts RNA encoding human elastin protein and containing adenosine, 50% guanosine, 50% 7-deazaguanosine, 60% uridine, 40% 5-methyluridine, and 5-methylcytidine, resolved on a denaturing formaldehyde-agarose gel.
Figure 2:
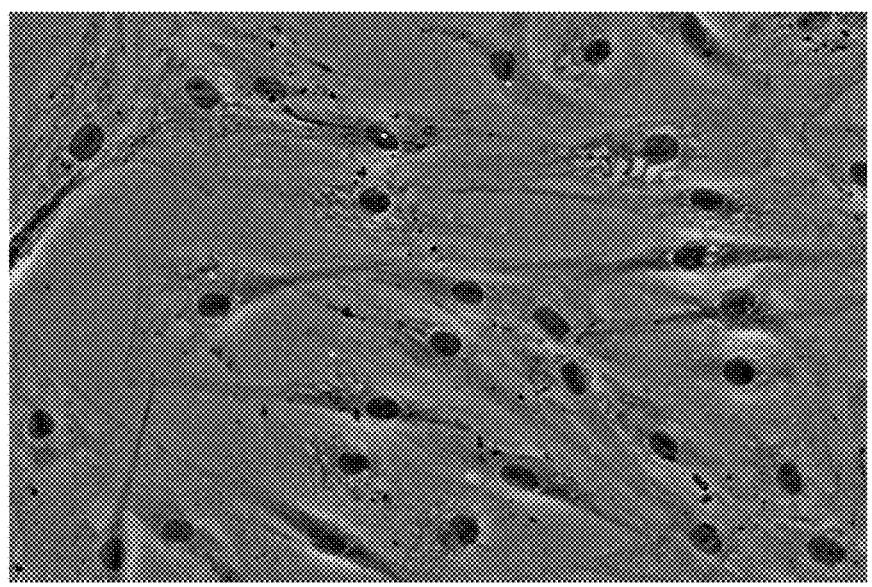
FIG. 2 depicts primary adult human dermal fibroblasts transfected with the RNA of FIG. 1.
Figure 3:
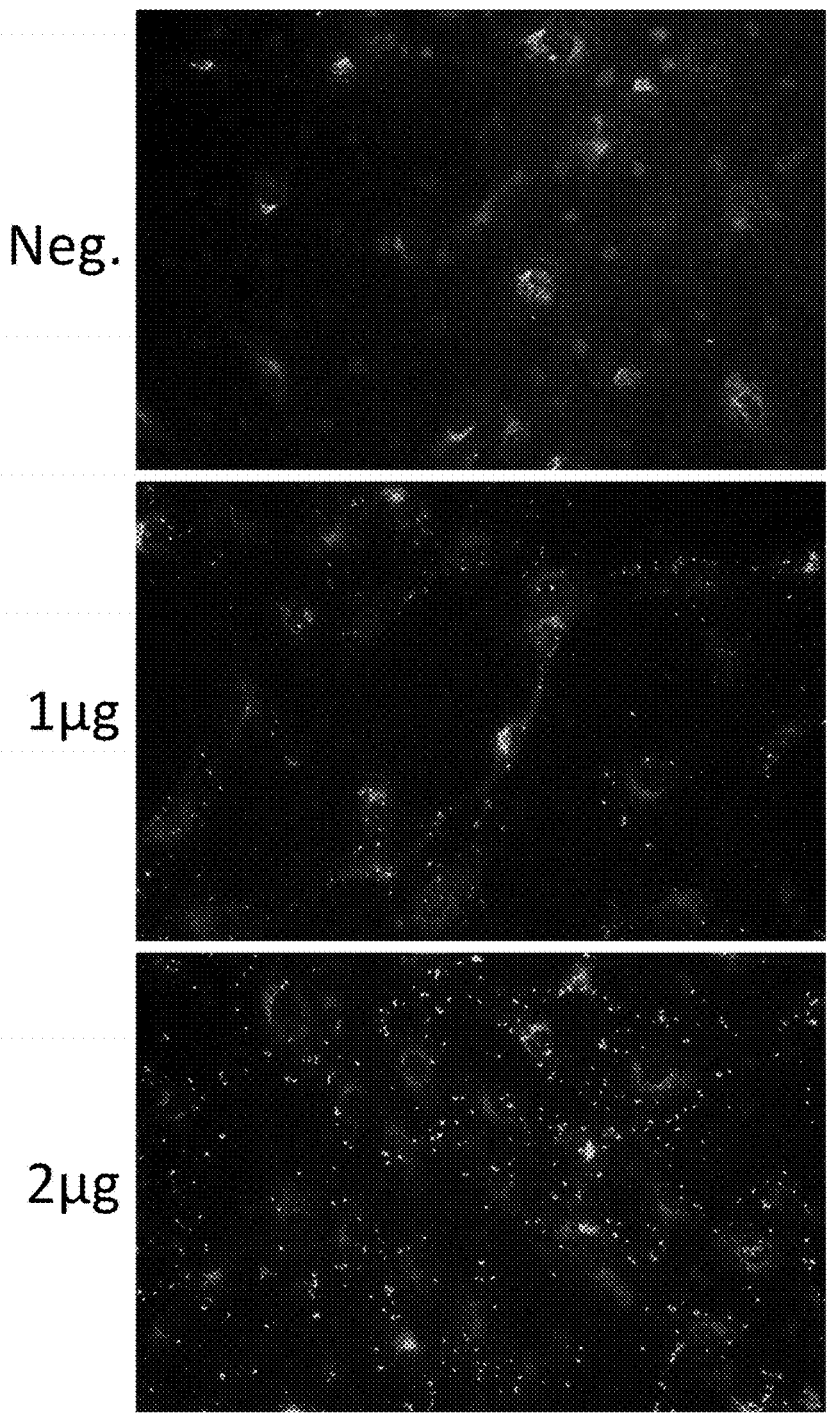
FIG. 3 depicts the result of an immunocytochemical analysis of the primary adult human dermal fibroblasts of FIG. 2 using an antibody targeting human elastin protein.
Figure 4:
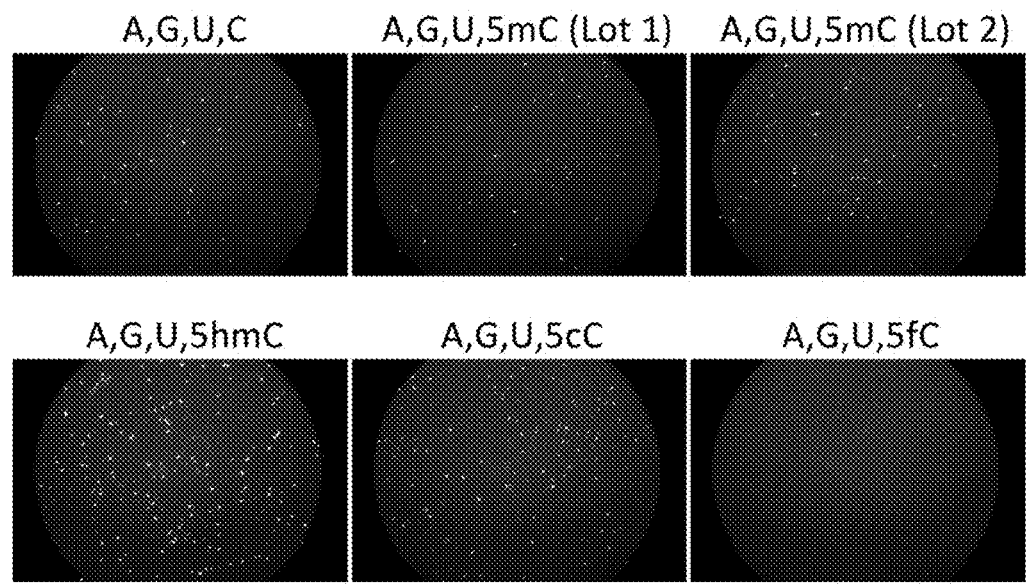
FIG. 4 depicts primary human dermal fibroblasts transfected with synthetic RNA comprising cytidine, 5-methylcytidine ("5mC"), 5-hydroxymethylcytidine ("5hmC"), 5-carboxycytidine ("5cC") or 5-formylcytidine ("5fC") and encoding Oct4 protein. Cells were fixed and stained for Oct4 protein 24 hours after transfection.
Figure 5:
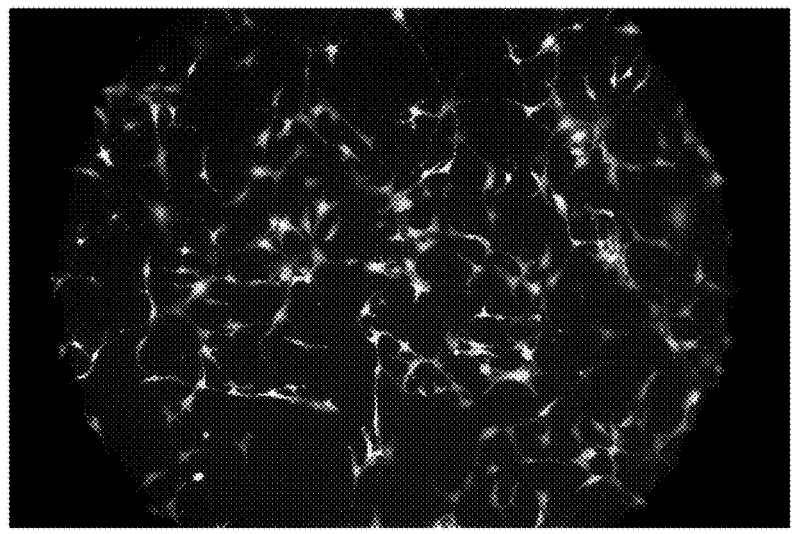
FIG. 5 depicts primary human dermal fibroblasts transfected with synthetic RNA comprising 5-hydroxymethylcytidine and encoding green fluorescent protein ("GFP"). Cells were imaged 24 hours after transfection.
Figure 6:
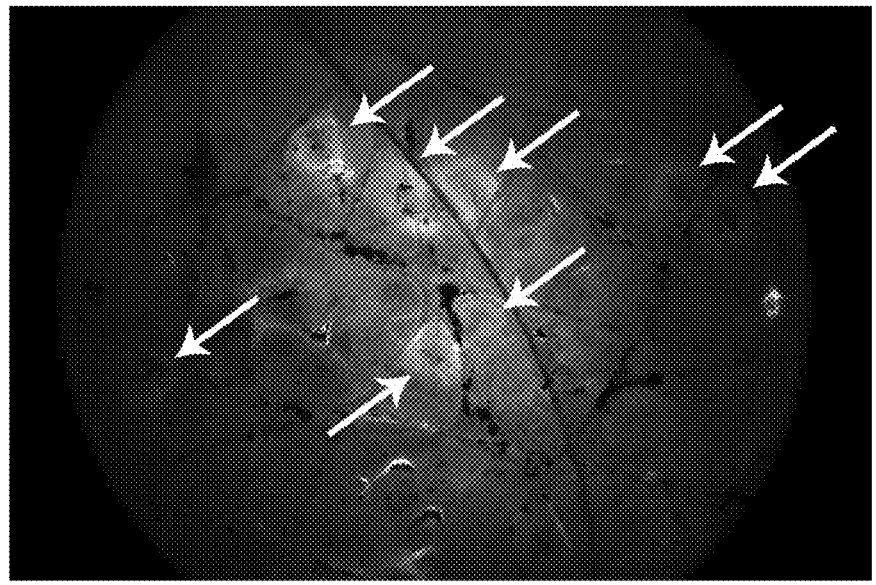
FIG. 6 depicts a region of the ventral forearm of a healthy, 33 year-old, male human subject treated with synthetic RNA comprising 5-hydroxymethylcytidine ("5hmC") and encoding GFP. Arrows indicate fluorescent cells.

RNA encoding human elastin was synthesized using the DNA template of Example 30 and the T7 High Yield RNA Synthesis Kit (New England Biolabs, Inc.), according to the manufacturer's instructions (Table 4). Samples of the RNA were analyzed by agarose gel electrophoresis to assess the quality of the RNA (FIG. 1).

The RNA was then diluted to 200 ng/µL and an RNase inhibitor (Superase•In™, Life Technologies Corporation) was added at a concentration of 1 µL/200 µg of RNA. The RNA solution was stored at 4 C.

Example 32 Production of Octanoate-Treated Human Serum Albumin

A 10% solution of HSA was pre-incubated with 16 mM sodium octanoate (Sigma-Aldrich Co. LLC), and was incubated at 37 C for 3 hours before assembly of the complete medium.

Example 33 Formulation for In Vivo Delivery of Nucleic Acids

The formulation for in vivo delivery of nucleic acids is prepared by combining RNA synthesized according to Example 31 and human serum albumin treated according to Examples 8, 9 and/or 32 in a suitable buffer (e.g., water, DMEM/F12, complexation medium, Opti-MEM, etc.).

Example 34 Increasing Elastin Production in Skin by Transdermal Injection Via Syringe of Treated Albumin and RNA Encoding Elastin The formulation of example 33 is loaded into an insulin syringe with a 28-gauge 0.5-inch needle and delivered to the dermis of a patient through the epidermis. Additional doses are administered as necessary.

Example 35 Increasing Elastin Production in Skin by Intradermal Injection Via Motorized Microneedle Array of Treated Albumin and RNA Encoding Elastin The formulation of example 33 is loaded into the chamber of a motorized microneedle array set to a penetration depth of approximately 0.1 mm. The microneedle array delivers the formulation to the dermis of a patient through the epidermis.

Example 36 Increasing Collagen Production in Skin by Transdermal Injection of Treated Albumin and RNA Encoding Collagen The formulation of example 33 is prepared using RNA encoding human collagen type I and/or type III. The formulation is delivered as in Example 34 or 35.

Example 37 Increasing Production of Actin in Skeletal Muscle by Intramuscular Injection of Treated Albumin and RNA Encoding Actin The formulation of example 33 is prepared using RNA encoding skeletal alpha actin. The formulation is delivered to the patient via intramuscular injection.

Example 38 Wound Healing Treatment

The formulation of example 33 is prepared using RNA encoding basic fibroblast growth factor. The formulation is delivered as in Example 34 or 35.

Example 39 Anti-Scarring Treatment

The formulation of example 33 is prepared using RNA encoding collagenase. The formulation is delivered as in Example 34 or 35.

Example 40 Generation of Tyrosinase ivT-RNA Template

Total RNA was extracted from human epidermal melanocytes using the RNeasy mini kit (QIAGEN GmbH), according to the manufacturer's instructions. cDNA encoding human tyrosinase was prepared using MonsterScript™ Reverse Transcriptase (Epicentre Biotechnologies). An in vitro transcription (ivT) template was prepared from the cDNA by PCR amplification of the tyrosinase coding sequence (CDS). The PCR product was then purified using agarose gel electrophoresis and the QIAquick Gel Extraction Kit (QIAGEN GmbH) and was cloned into a vector containing the human beta globin (HBB) 5' and 3' untranslated regions and a strong Kozak sequence. The vector was amplified, purified, and linearized prior to RNA synthesis.

Example 41 Synthesis of Tyrosinase RNA

RNA encoding human tyrosinase was synthesized according to Example 1, using the DNA template of Example 40 and the T7 High Yield RNA Synthesis Kit (New England Biolabs, Inc.), according to the manufacturer's instructions (Table 4). Samples of the RNA were analyzed by agarose gel electrophoresis to assess the quality of the RNA. The RNA was then diluted to 1 μg/μL. The RNA solution was stored at 4 C.

Example 42 Production of Octanoate-Treated Human Serum Albumin

A 10% solution of HSA was pre-incubated with 16 mM sodium octanoate (Sigma-Aldrich Co. LLC), and was incubated at 37 C for 3 hours before assembly of the complete medium.

Example 43 Increasing Melanin Production in Skin by Transdermal Injection Via Syringe of RNA Encoding Tyrosinase The RNA of Example 41 was loaded into a syringe and delivered to the dermis of the ventral forearm of a healthy 33 year-old male patient over the course of approximately 30 seconds.

Example 44 Increasing Melanin Production in Skin by Combined Delivery of RNA Encoding Tyrosinase and Electroporation The area of skin treated in Example 43 was exposed to electrical pulses of between 10V and 155V and between approximately 10 milliseconds and approximately 1 second using a two-electrode array electrically connected to a capacitor. The patient reported a tingling sensation at all voltages and penetration depths. The treated area became darker after 24-48 hours (see FIG. 16). The experiment was repeated several times, with similar results.

Example 45 Increasing Melanin Production in Skin by Topical or Intradermal Application of RNA Encoding Tyrosinase The RNA of Example 41 or the liposomes of Example 29 are applied directly to the skin, with or without disruption of the stratum corneum or injected intradermally using a dose of one microgram or less per square centimeter. Optionally, an electric field is applied as in Example 44 or using a surface-contact patch to enhance delivery of the RNA.

Example 46 Increasing Elastin Production in Skin by Transdermal Delivery of RNA Encoding Elastin RNA encoding elastin was prepared according to Example 1. The RNA is delivered as in Example 43, 44 or 45.

Example 47 Increasing Collagen Production in Skin by Transdermal Delivery of RNA Encoding Collagen RNA encoding collagen was prepared according to Example 1. The RNA is delivered as in Example 43, 44 or 45.

Example 48 Anemia Therapy Comprising Delivery of RNA Encoding Erythropoietin or Darbepoetin RNA encoding darbepoetin alfa was prepared according to Example 1. The RNA is delivered as in Example 43, 44 or 45.

Example 49 Increasing Production of Actin in Skeletal Muscle by Intramuscular Delivery of RNA Encoding Actin RNA encoding actin is prepared according to Example 1. The RNA is delivered to the patient via intramuscular injection with or without the use of an electric field as in Example 43, 44 or 45.

Example 50 Wound Healing Treatment

RNA encoding basic fibroblast growth factor is prepared according to Example 1. The RNA is delivered as in Example 43, 44 or 45.

Example 51 Anti-Scarring Treatment

RNA encoding collagenase is prepared according to Example 1. The RNA is delivered as in Example 43, 44 or 45.

Example 52 Production of Botulinum Toxin

RNA encoding botulinum toxin is prepared according to Example 1. The RNA is delivered as in Example 43, 44 or 45.

Example 53 Increasing Collagen Production in Skin Cells by Transfection with RNA Encoding Collagen I RNA comprising the coding sequence of the human COL1A1 gene was synthesized according to Example 1. Primary human dermal fibroblasts were plated in wells of a 24-well plate, and were transfected according to Example 2. Between 24 and 72 hours after transfection, the cells were fixed and stained using an antibody targeting collagen I. Many extracellular deposits of collagen were visible in the transfected wells (FIG. 17).

Example 54 Increasing Collagen Production in Skin Cells by Transfection with RNA Encoding Collagen VII RNA comprising the coding sequence of the human COL7 gene was synthesized according to Example 1. Primary human dermal fibroblasts were plated in wells of a 24-well plate, and were transfected according to Example 2. Between 24 and 72 hours after transfection, the cells were fixed and stained using an antibody targeting collagen VII. Transfected cells exhibited high levels of collagen VII, compared to an un-transfected control (FIG. 18).

Example 55 Increasing Collagen Production in Skin by Transdermal Injection Via Syringe of RNA Encoding Collagen I or Collagen VII RNA comprising the coding sequence of the human COL1A1 gene or the human COL7 gene was synthesized according to Example 1. The RNA is loaded into a syringe and delivered to the dermis of a patient over the course of approximately 30 seconds or as in Example 43, 44 or 45.

Example 56 Increasing Collagen Production in Skin by Combined Delivery of RNA Encoding Collagen I or Collagen VII and Electroporation The area of skin treated in Example 55 is exposed to electrical pulses of between 10V and 155V and between approximately 50 microseconds and approximately 1 second using a multi-electrode array electrically connected to a power source.

EQUIVALENTS

Those skilled in the art will recognize, or be able to ascertain, using no more than routine experimentation, numerous equivalents to the specific embodiments described specifically herein. Such equivalents are intended to be encompassed in the scope of the following claims.

INCORPORATION BY REFERENCE

All patents and publications referenced herein are hereby incorporated by reference in their entireties.

SEQUENCE LISTING (168 sequences)

SEQ ID NO: 1 - protein, 195 aa, Homo sapiens
VLEKSDIEKFKNQLRTELTNIDHSYLKGIDIASKKKTSNVENTEFEAISTKIFTDELGFSGKHLGGSNKPDGLLWDDDCAIILDSKAYSEGFPLTASHTDAMGRYLRQFTERKEEIKPTWWDIAPEHLDNTYFAYVSGSFSGNYKEQLQKFRQDTNHLGGALEFVKLLLLANNYKTQKMSKKEVKKSILDYNISY

SEQ ID NO: 2 - protein, 195 aa, Homo sapiens
VLEKSDIEKFKNQLRTELTNIDHSYLKGIDIASKKKTSNVENTEFEAISTKIFTDELGFSGEHLGGSNKPDGLLWDDDCAIILDSKAYSEGFPLTASHTDAMGRYLRQFTERKEEIKPTWWDIAPEHLDNTYFAYVSGSFSGNYKEQLQKFRQDTNHLGGALEFVKLLLLANNYKTQKMSKKEVKKSILDYNISY

SEQ ID NO: 3 - protein, 195 aa, Homo sapiens
VLEKSDIEKFKNQLRTELTNIDHSYLKGIDIASKPKTSNVENTEFEAISTKIFTDELGFSGKHLGGSNKPDGLLWDDDCAIILDSKAYSEGFPLTASHTDAMGRYLRQFTERKEEIKPTWWDIAPEHLDNTYFAYVSGSFSGNYKEQLQKFRQDTNHLGGALEFVKLLLLANNYKTQKMSKKEVKKSILDYNISY

SEQ ID NO: 4 - protein, 195 aa, Homo sapiens
VLEKSDIEKFKNQLRTELTNIDHSYLKGIDIASKPKTSNVENTEFEAISTKIFTDELGFSGEHLGGSNKPDGLLWDDDCAIILDSKAYSEGFPLTASHTDAMGRYLRQFTERKEEIKPTWWDIAPEHLDNTYFAYVSGSFSGNYKEQLQKFRQDTNHLGGALEFVKLLLLANNYKTQKMSKKEVKKSILDYNISY

SEQ ID NO: 5 - protein, 191 aa, Homo sapiens
VLEKSDIEKFKNQLRTELTNIDHSYLKGIDIASKPVENTEFEAISTKIFTDELGFSGEHLGGSNKPDGLLWDDDCAIILDSKAYSEGFPLTASHTDAMGRYLRQFTERKEEIKPTWWDIAPEHLDNTYFAYVSGSFSGNYKEQLQKFRQDTNHLGGALEFVKLLLLANNYKTQKMSKKEVKKSILDYNISY

SEQ ID NO: 6 - protein, 195 aa, Homo sapiens
VLEKSDIEKFKNQLRTELTNIDHSYLKGIDIASKKKTSNVENTEFEAISTKIFTDELGFSGKHLGGSNKPDGLLWDDDCAIILDSKAYSEGFPLTASHTDAMGRYLRQFTERKEEIKPTWWDIAPEHLDNTYFAYVSGSFSGDYKEQLQKFRQDTNHLGGALEFVKLLLLANNYKTQKMSKKEVKKSILDYNISY

SEQ ID NO: 7 - protein, 195 aa, Homo sapiens
VLEKSDIEKFKNQLRTELTNIDHSYLKGIDIASKKKTSNVENTEFEAISTKIFTDELGFSGKHLGGSNKPDGLLWDDDCAIILDSKAYSEGFPLTASHTDAMGRYLRQFTERKEEIKPTWWDIAPEHLDNTYFAYVSGSFSGDYKEQLQKFRQNTNHLGGALEFVKLLLLANNYKTQKMSKKEVKKSILDYNISY

SEQ ID NO: 8 - protein, 360 aa, Homo sapiens
MAGHLASDFAFSPPPGGGGDGPGGPEPGWVDPRTWLSFQGPPGGPGIGPGVGPGSEVWGIPPCPPPYEFCGGMAYCGPQVGVGLVPQGGLETSQPEGEAGVGVESNSDGASPEPCTVTPGAVKLEKEKLEQNPEESQDIKALQKELEQFAKLLKQKRITLGYTQADVGLTLGVLFGKVFSQTTICRFEALQLSFKNMCKLRPLLQKWVEEADNNENLQEICKAETLVQARKRKRTSIENRVRGNLENLFLQCPKPTLQQISHIAQQLGLEKDVVRVWFCNRRQKGKRSSSDYAQREDFEAAGSPFSGGPVSFPLAPGPHFGTPGYGSPHFTALYSSVPFPEGEAFPPVSVTTLGSPMHSN

SEQ ID NO: 9 - protein, 317 aa, Homo sapiens
MYNMMETELKPPGPQQTSGGGGGNSTAAAAGGNQKNSPDRVKRPMNAFMVWSRGQRRKMAQENPKMHNSEISKRLGAEWKLLSETEKRPFIDEAKRLRALHMKEHPDYKYRPRRKTKTLMKKDKYTLPGGLLAPGGNSMASGVGVGAGLGAGVNQRMDSYAHMNGWSNGSYSMMQDQLGYPQHPGLNAHGAAQMQPMHRYDVSALQYNSMTSSQTYMNGSPTYSMSYSQQGTPGMALGSMGSVVKSEASSSPPVVTSSSHSRAPCQAGDLRDMISMYLPGAEVPEPAAPSRLHMSQHYQSGPVPGTAINGTLPLSHM

SEQ ID NO: 10 - protein, 479 aa, Homo sapiens
MRQPPGESDMAVSDALLPSFSTFASGPAGREKTLRQAGAPNNRWREELSHMKRLPPVLPGRPYDLAAATVATDLESGGAGAACGGSNLAPLPRRETEEFNDLLDLDFILSNSLTHPPESVAATVSSSASASSSSSPSSSGPASAPSTCSFTYPIRAGNDPGVAPGGTGGGLLYGRESAPPPTAPFNLADINDVSPSGGFVAELLRPELDPVYIPPQQPQPPGGGLMGKFVLKASLSAPGSEYGSPSVISVSKGSPDGSHPVVVAPYNGGPPRTCPKIKQEAVSSCTHLGAGPPLSNGHRPAAHDFPLGRQLPSRTTPTLGLEEVLSSRDCHPALPLPPGFHPHPGPNYPSFLPDQMQPQVPPLHYQELMPPGSCMPEEPKPKRGRRSWPRKRTATHTCDYAGCGKTYTKSSHLKAHLRTHTGEKPYHCDWDGCGWKFARSDELTRHYRKHTGHRPFQCQKCDRAFSRSDHLALHMKRHF

SEQ ID NO: 11 - protein, 454 aa, Homo sapiens
MDFFRVVENQQPPATMPLNVSFTNRNYDLDYDSVQPYFYCDEEENFYQQQQQSELQPPAPSEDIWKKFELLPTPPLSPSRRSGLCSPSYVAVTPFSLRGDNDGGGGSFSTADQLEMVTELLGGDMVNQSFICDPDDETFIKNIIIQDCMWSGFSAAAKLVSEKLASYQAARKDSGSPNPARGHSVCSTSSLYLQDLSAAASECIDPSVVFPYPLNDSSSPKSCASQDSSAFSPSSDSLLSSTESSPQGSPEPLVLHEETPPTTSSDSEEEQEDEEEIDVVSVEKRQAPGKRSESGSPSAGGHSKPPHSPLVLKRCHVSTHQHNYAAPPSTRKDYPAAKRVKLDSVRVLRQISNNRKCTSPRSSDTEENVKRRTHNVLERQRRNELKRSFFALRDQIPELENNEKAPKVVILKKATAYILSVQAEEQKLISEEDLLRKRREQLKHKLEQLRNSCA

SEQ ID NO: 12 - DNA, 191 bp, Homo sapiens
ttgaatcgcgggacccgttggcagaggtggcggcggcggcatgggtgccccgacgttgccccctgcctggcagccctttctcaaggaccaccgcatctctacattcaagaactggcccttcttggagggctgcgcctgcaccccggagcgggtgagactgcccggcctcctggggtcccccacgcccgcct

SEQ ID NO: 13 - DNA, 190 bp, Homo sapiens
ggctgccacgtccactcacgagctgtgctgtcccttgcagatggccgaggctggcttcatccactgccccactgagaacgagccagacttggcccagtgtttcttctgcttcaaggagctggaaggctgggagccagatgacgaccccatgtaagtcttctctggccagcctcgatgggctttgttttga

SEQ ID NO: 14 - DNA, 198 bp, Homo sapiens
cccttcagctgcctttccgctgttgttttgatttttctagagaggaacataaaaagcattcgtccggttgcgctttcctttctgtcaagaagcagtttgaagaattaacccttggtgaatttttgaaactggacagagaaagagccaagaacaaaattgtatgtattgggaataagaactgctcaaaccctgttcaat

SEQ ID NO: 15 - DNA, 170 bp, Homo sapiens
gctctggtttcagtgtcatgtgtctattctttatttccaggcaaaggaaaccaacaataagaagaaagaatttgaggaaactgcggagaaagtgcgccgtgccatcgagcagctggctgccatggattgaggcctctggccggagctgcctggtcccagagtggctgcac

SEQ ID NO: 16 - DNA, 20 bp, Homo sapiens
ttgccccctgcctggcagcc

SEQ ID NO: 17 - DNA, 20 bp, Homo sapiens
ttcttgaatgtagagatgcg

SEQ ID NO: 18 - DNA, 20 bp, Homo sapiens
tgggtgccccgacgttgccc

SEQ ID NO: 19 - DNA, 20 bp, Homo sapiens
tgcggtggtccttgagaaag

SEQ ID NO: 20 - DNA, 20 bp, Homo sapiens
tcaaggaccaccgcatctct

SEQ ID NO: 21 - DNA, 20 bp, Homo sapiens
tgcaggcgcagccctccaag

SEQ ID NO: 22 - DNA, 20 bp, Homo sapiens
tggccgaggctggcttcatc

SEQ ID NO: 23 - DNA, 20 bp, Homo sapiens
tgggccaagtctggctcgtt

SEQ ID NO: 24 - DNA, 20 bp, Homo sapiens
ttggcccagtgtttcttctg

SEQ ID NO: 25 - DNA, 20 bp, Homo sapiens
tcgtcatctggctcccagcc

SEQ ID NO: 26 - DNA, 20 bp, Homo sapiens
tgcgctttcctttctgtcaa

SEQ ID NO: 27 - DNA, 20 bp, Homo sapiens
tcaaaaattcaccaagggtt

SEQ ID NO: 28 - protein, 297 aa, Homo sapiens
MEDYTKIEKIGEGTYGVVYKGRHKTTGQVVAMKKIRLESEEEGVPSTAIREISLLKELRHPNIVSLQDVLMQDSRLYLIFEFLSMDLKKYLDSIPPGQYMDSSLVKSYLYQILQGIVFCHSRRVLHRDLKPQNLLIDDKGTIKLADFGLARAFGIPIRVYTHEVVTLWYRSPEVLLGSARYSTPVDIWSIGTIFAELATKKPLFHGDSEIDQLFRIFRALGTPNNEVWPEVESLQDYKNTFPKWKPGSLASHVKNLDENGLDLLSKMLIYDPAKRISGKMALNHPYFNDLDNQIKKM

SEQ ID NO: 29 - protein, 298 aa, Homo sapiens
MENFQKVEKIGEGTYGVVYKARNKLTGEVVALKKIRLDTETEGVPSTAIREISLLKELNHPNIVKLLDVIHTENKLYLVFEFLHQDLKKFMDASALTGIPLPLIKSYLFQLLQGLAFCHSHRVLHRDLKPQNLLINTEGAIKLADFGLARAFGVPVRTYTHEVVTLWYRAPEILLGCKYYSTAVDIWSLGCIFAEMVTRRALFPGDSEIDQLFRIFRTLGTPDEVVWPGVTSMPDYKPSFPKWARQDFSKVVPPLDEDGRSLLSQMLHYDPNKRISAKAALAHPFFQDVTKPVPHLRL

SEQ ID NO: 30 - protein, 305 aa, Homo sapiens
MDMFQKVEKIGEGTYGVVYKAKNRETGQLVALKKIRLDLEMEGVPSTAIREISLLKELKHPNIVRLLDVVHNERKLYLVFEFLSQDLKKYMDSTPGSELPLHLIKSYLFQLLQGVSFCHSHRVIHRDLKPQNLLINELGAIKLADFGLARAFGVPLRTYTHEVVTLWYRAPEILLGSKFYTTAVDIWSIGCIFAEMVTRKALFPGDSEIDQLFRIFRMLGTPSEDTWPGVTQLPDYKGSFPKWTRKGLEEIVPNLEPEGRDLLMQLLQYDPSQRITAKTALAHPYFSSPEPSPAARQYVLQRFRH

SEQ ID NO: 31 - protein, 303 aa, Homo sapiens
MATSRYEPVAEIGVGAYGTVYKARDPHSGHFVALKSVRVPNGGGGGGGLPISTVREVALLRRLEAFEHPNVVRLMDVCATSRTDREIKVTLVFEHVDQDLRTYLDKAPPPGLPAETIKDLMRQFLRGLDFLHANCIVHRDLKPENILVTSGGTVKLADFGLARIYSYQMALTPVVVTLWYRAPEVLLQSTYATPVDMWSVGCIFAEMFRRKPLFCGNSEADQLGKIFDLIGLPPEDDWPRDVSLPRGAFPPRGPRPVQSVVPEMEESGAQLLLEMLTFNPHKRISAFRALQHSYLHKDEGNPE

SEQ ID NO: 32 - protein, 292 aa, Homo sapiens
MQKYEKLEKIGEGTYGTVFKAKNRETHEIVALKRVRLDDDDEGVPSSALREICLLKELKHKNIVRLHDVLHSDKKLTLVFEFCDQDLKKYFDSCNGDLDPEIVKSFLFQLLKGLGFCHSRNVLHRDLKPQNLLINRNGELKLADFGLARAFGIPVRCYSAEVVTLWYRPPDVLFGAKLYSTSIDMWSAGCIFAELANAGRPLFPGNDVDDQLKRIFRLLGTPTEEQWPSMTKLPDYKPYPMYPATTSLVNVVPKLNATGRDLLQNLLKCNPVQRISAEEALQHPYFSDFCPP

SEQ ID NO: 33 - protein, 326 aa, Homo sapiens
MEKDGLCRADQQYECVAEIGEGAYGKVFKARDLKNGGRFVALKRVRVQTGEEGMPLSTIREVAVLRHLETFEHPNVVRLFDVCTVSRTDRETKLTLVFEHVDQDLTTYLDKVPEPGVPTETIKDMMFQLLRGLDFLHSHRVVHRDLKPQNILVTSSGQIKLADFGLARIYSFQMALTSVVVTLWYRAPEVLLQSSYATPVDLWSVGCIFAEMFRRKPLFRGSSDVDQLGKILDVIGLPGEEDWPRDVALPRQAFHSKSAQPIEKFVTDIDELGKDLLLKCLTFNPAKRISAYSALSHPYFQDLERCKENLDSHLPPSQNTSELNTA

SEQ ID NO: 34 - protein, 142 aa, Homo sapiens
MGAPTLPPAWQPFLKDHRISTFKNWPFLEGCACTPERMAEAGFIHCPTENEPDLAQCFFCFKELEGWEPDDDPIEEHKKHSSGCAFLSVKKQFEELTLGEFLKLDRERAKNKIAKETNNKKKEFEETAEKVRRAIEQLAAMD

SEQ ID NO: 35 - protein, 826 aa, Homo sapiens
MEGAGGANDKKKISSERRKEKSRDAARSRRSKESEVFYELAHQLPLPHNVSSHLDKASVMRLTISYLRVRKLLDAGDLDIEDDMKAQMNCFYLKALDGFVMVLTDDGDMIYISDNVNKYMGLTQFELTGHSVFDFTHPCDHEEMREMLTHRNGLVKKGKEQNTQRSFFLRMKCTLTSRGRTMNIKSATWKVLHCTGHIHVYDTNSNQPQCGYKKPPMTCLVLICEPIPHPSNIEIPLDSKTFLSRHSLDMKFSYCDERITELMGYEPEELLGRSIYEYYHALDSDHLTKTHHDMFTKGQVTTGQYRMLAKRGGYVWVETQATVIYNTKNSQPQCIVCVNYVVSGIIQHDLIFSLQQTECVLKPVESSDMKMTQLFTKVESEDTSSLFDKLKKEPDALTLLAPAAGDTIISLDFGSNDTETDDQQLEEVPLYNDVMLPSPNEKLQNINLAMSPLPTAETPKPLRSSADPALNQEVALKLEPNPESLELSFTMPQIQDQTPSPSDGSTRQSSPEPNSPSEYCFYVDSDMVNEFKLELVEKLFAEDTEAKNPFSTQDTDLDLEMLAPYIPMDDDFQLRSFDQLSPLESSSASPESASPQSTVTVFQQTQIQEPTANATTTTATTDELKTVTKDRMEDIKILIASPSPTHIHKETTSATSSPYRDTQSRTASPNRAGKGVIEQTEKSHPRSPNVLSVALSQRTTVPEEELNPKILALQNAQRKRKMEHDGSLFQAVGIGTLLQQPDDHAATTSLSWKRVKGCKSSEQNGMEQKTIILIPSDLACRLLGQSMDESGLPQLTSYDCEVNAPIQGSRNLLQGEELLRALDQVN

SEQ ID NO: 36 - protein, 449 aa, Homo sapiens
MGRVGGMAQPMGRAGAPKPMGRAGSARRGRFKGCWSEGSPVHPVPAVLSWLLALLRCASTMLSLRVPLAPITDPQQLQLSPLKGLSLVDKENTPPALSGTRVLASKTARRIFQEPTEPKTKAAAPGVEDEPLLRENPRRFVIFPIEYHDIWQMYKKAEASFWTAEEVDLSKDIQHWESLKPEERYFISHVLAFFAASDGIVNENLVERFSQEVQITEARCFYGFQIAMENIHSEMYSLLIDTYIKDPKEREFLFNAIETMPCVKKKADWALRWIGDKEATYGERVVAFAAVEGIFFSGSFASIFWLKKRGLMPGLTFSNELISRDEGLHCDFACLMFKHLVHKPSEERVREIIINAVRIEQEFLTEALPVKLIGMNCTLMKQYIEFVADRLMLELGFSKVFRVENPFDFMENISLEGKTNFFEKRVGEYQRMGVMSSPTENSFTLDADF

SEQ ID NO: 37 - protein, 188 aa, Homo sapiens [sequence omitted]

SEQ ID NO: 38 - protein, 1210 aa, Homo sapiens [sequence omitted]

SEQ ID NO: 39 - protein, 454 aa, Homo sapiens; identical to SEQ ID NO: 11

SEQ ID NO: 40 - protein, 889 aa, Homo sapiens
MEEGAPRQPGPSQWPPEDEKEVIRRAIQKELKIKEGVENLRRVATDRRHLGHVQQLLRSSNRRLEQLHGELRELHARILLPGPGPGPAEPVASGPRPWAEQLRARHLEALRRQLHVELKVKQGAENMTHTCASGTPKERKLLAAAQQMLRDSQLKVALLRMKISSLEASGSPEPGPELLAEELQHRLHVEAAVAEGAKNVVKLLSSRRTQDRKALAEAQAQLQESSQKLDLLRLALEQLLEQLPPAHPLRSRVTRELRAAVPGYPQPSGTPVKPTALTGTLQVRLLGCEQLLTAVPGRSPAAALASSPSEGWLRTKAKHQRGRGELASEVLAVLKVDNRVVGQTGWGQVAEQSWDQTFVIPLERARELEIGVHWRDWRQLCGVAFLRLEDFLDNACHQLSLSLVPQGLLFAQVTFCDPVIERRPRLQRQERIFSKRRGQDFLRASQMNLGMAAWGRLVMNLLPPCSSPSTISPPKGCPRTPTTLREASDPATPSNFLPKKTPLGEEMTPPPKPPRLYLPQEPTSEETPRTKRPHMEPRTRRGPSPPASPTRKPPRLQDFRCLAVLGRGHFGKVLLVQFKGTGKYYAIKALKKQEVLSRDEIESLYCEKRILEAVGCTGHPFLLSLLACFQTSSHACFVTEFVPGGDLMMQIHEDVFPEPQARFYVACVVLGLQFLHEKKIIYRDLKLDNLLLDAQGFLKIADFGLCKEGIGFGDRTSTFCGTPEFLAPEVLTQEAYTRAVDWWGLGVLLYEMLVGECPFPGDTEEEVFDCIVNMDAPYPGFLSVQGLEFIQKLLQKCPEKRLGAGEQDAEEIKVQPFFRTTNWQALLARTIQPPFVPTLCGPADLRYFEGEFTGLPPALTPPAPHSLLTARQQAAFRDFDFVSERFLEP

SEQ ID NO: 41 - protein, 1056 aa, Homo sapiens
MASQPNSSAKKKEEKGKNIQVVVRCRPFNLAERKASAHSIVECDPVRKEVSVRTGGLADKSSRKTYTFDMVFGASTKQIDVYRSVVCPILDEVIMGYNCTIFAYGQTGTGKTFTMEGERSPNEEYTWEEDPLAGIIPRTLHQIFEKLTDNGTEFSVKVSLLEIYNEELFDLLNPSSDVSERLQMFDDPRNKRGVIIKGLEEITVHNKDEVYQILEKGAAKRTTAATLMNAYSSRSHSVFSVTIHMKETTIDGEELVKIGKLNLVDLAGSENIGRSGAVDKRAREAGNINQSLLTLGRVITALVERTPHVPYRESKLTRILQDSLGGRTRTSIIATISPASLNLEETLSTLEYAHRAKNILNKPEVNQKLTKKALIKEYTEEIERLKRDLAAAREKNGVYISEENFRVMSGKLTVQEEQIVELIEKIGAVEEELNRVTELFMDNKNELDQCKSDLQNKTQELETTQKHLQETKLQLVKEEYITSALESTEEKLHDAASKLLNTVEETTKDVSGLHSKLDRKKAVDQHNAEAQDIFGKNLNSLFNNMEELIKDGSSKQKAMLEVHKTLFGNLLSSSVSALDTITTVALGSLTSIPENVSTHVSQIFNMILKEQSLAAESKTVLQELINVLKTDLLSSLEMILSPTVVSILKINSQLKHIFKTSLTVADKIEDQKKELDGFLSILCNNLHELQENTICSLVESQKQCGNLTEDLKTIKQTHSQELCKLMNLWTERFCALEEKCENIQKPLSSVQENIQQKSKDIVNKMTFHSQKFCADSDGFSQELRNFNQEGTKLVEESVKHSDKLNGNLEKISQETEQRCESLNTRTVYFSEQWVSSLNEREQELHNLLEVVSQCCEASSSDITEKSDGRKAAHEKQHNIFLDQMTIDEDKLIAQNLELNETIKIGLTKLNCFLEQDLKLDIPTGTTPQRKSYLYPSTLVRTEPREHLLDQLKRKQPELLMMLNCSENNKEETIPDVDVEEAVLGQYTEEPLSQEPSVDAGVDCSSIGGVPFFQHKKSHGKDKENRGINTLERSKVEETTEHLVTKSRLPLRAQINL

SEQ ID NO: 42 - protein, 2825 aa, Homo sapiens
MYASLGSGPVAPLPASVPPSVLGSWSTGGSRSCVRQETKSPGGARTSGHWASVWQEVLKQLQGSIEDEAMASSGQIDLLERLKELNLDSSNFPGVKLRSKMSLRSYGSREGSVSSRSGECSPVPMGSFPRRGFVNGSRESTGYLEELEKERSLLLADLDKEEKEKDWYYAQLQNLTKRIDSLPLTENFSLQTDMTRRQLEYEARQIRVAMEEQLGTCQDMEKRAQRSSQNKHETGSHDAERQNEGQGVGEINMATSGNGQGSTTRMDHETASVLSSSSTHSAPRRLTSHLGTKVEMVYSLLSMLGTHDKDDMSRTLLAMSSSQDSCISMRQSGCLPLLIQLLHGNDKDSVLLGNSRGSKEARARASAALHNIIHSQPDDKRGRREIRVLHLLEQIRAYCETCWEWQEAHEPGMDQDKNPMPAPVEHQICPAVCVLMKLSFDEEHRHAMNELGGLQAIAELLQVDCEMYGLTNDHYSITLRRYAGMALTNLTFGDVANKATLCSMKGCMRALVAQLKSESEDLQQVIASVLRNLSWRADVNSKKTLREVGSVKALMECALEVKKESTLKSVLSALWNLSAHCTENKADICAVDGALAFLVGTLTYRSQTNTLAIIESGGGILRNVSSLIATNEDHRQILRENNCLQTLLQHLKSHSLTIVSNACGTLWNLSARNPKDQEALWDMGAVSMLKNLIHSKHKMIAMGSAAALRNLMANRPAKYKDANIMSPGSSLPSLHVRKQKALEAELDAQHLSETFDNIDNLSPKASHRSKQRHKQSLYGDYVFDTNRHDDNRSDNFNTGNMTVLSPYLNTTVLPSSSSSRGSLDSSRSEKDRSLERERGIGLGNYHPATENPGTSSKRGLQISTTAAQIAKVMEEVSAIHTSQEDRSSGSTTELHCVTDERNALRRSSAAHTHSNTYNFTKSENSNRTCSMPYAKLEYKRSSNDSLNSVSSSDGYGKRGQMKPSIESYSEDDESKFCSYGQYPADLAHKIHSANHMDDNDGELDTPINYSLKYSDEQLNSGRQSPSQNERWARPKHIIEDEIKQSEQRQSRNQSTTYPVYTESTDDKHLKFQPHFGQQECVSPYRSRGANGSETNRVGSNHGINQNVSQSLCQEDDYEDDKPTNYSERYSEEEQHEEEERPTNYSIKYNEEKRHVDQPIDYSLKYATDIPSSQKQSFSFSKSSSGQSSKTEHMSSSSENTSTPSSNAKRQNQLHPSSAQSRSGQPQKAATCKVSSINQETIQTYCVEDTPICFSRCSSLSSLSSAEDEIGCNQTTQEADSANTLQIAEIKEKIGTRSAEDPVSEVPAVSQHPRTKSSRLQGSSLSSESARHKAVEFSSGAKSPSKSGAQTPKSPPEHYVQETPLMFSRCTSVSSLDSFESRSIASSVQSEPCSGMVSGIISPSDLPDSPGQTMPPSRSKTPPPPPQTAQTKREVPKNKAPTAEKRESGPKQAAVNAAVQRVQVLPDADTLLHFATESTPDGFSCSSSLSALSLDEPFIQKDVELRIMPPVQENDNGNETESEQPKESNENQEKEAEKTIDSEKDLLDDSDDDDIEILEECIISAMPTKSSRKAKKPAQTASKLPPPVARKPSQLPVYKLLPSQNRLQPQKHVSFTPGDDMPRVYCVEGTPINFSTATSLSDLTIESPPNELAAGEGVRGGAQSGEFEKRDTIPTEGRSTDEAQGGKTSSVTIPELDDNKAEEGDILAECINSAMPKGKSHKPFRVKKIMDQVQQASASSSAPNKNQLDGKKKKPTSPVKPIPQNTEYRTRVRKNADSKNNLNAERVFSDNKDSKKQNLKNNSKVFNDKLPNNEDRVRGSFAFDSPHHYTPIEGTPYCFSRNDSLSSLDFDDDDVDLSREKAELRKAKENKESEAKVTSHTELTSNQQSANKTQAIAKQPINRGQPKPILQKQSTFPQSSKDIPDRGAATDEKLQNFAIENTPVCFSHNSSLSSLSDIDQENNNKENEPIKETEPPDSQGEPSKPQASGYAPKSFHVEDTPVCFSRNSSLSSLSIDSEDDLLQECISSAMPKKKKPSRLKGDNEKHSPRNMGGILGEDLTLDLKDIQRPDSEHGLSPDSENFDWKAIQEGANSIVSSLHQAAAAACLSRQASSDSDSILSLKSGISLGSPFHLTPDQEEKPFTSNKGPRILKPGEKSTLETKKIESESKGIKGGKKVYKSLITGKVRSNSEISGQMKQPLQANMPSISRGRTMIHIPGVRNSSSSTSPVSKKGPPLKTPASKSPSEGQTATTSPRGAKPSVKSELSPVARQTSQIGGSSKAPSRSGSRDSTPSRPAQQPLSRPIQSPGRNSISPGRNGISPPNKLSQLPRTSSPSTASTKSSGSGKMSYTSPGRQMSQQNLTKQTGLSKNASSIPRSESASKGLNQMNNGNGANKKVELSRMSSTKSSGSESDRSERPVLVRQSTFIKEAPSPTLRRKLEESASFESLSPSSRPASPTRSQAQTPVLSPSLPDMSLSTHSSVQAGGWRKLPPNLSPTIEYNDGRPAKRHDIARSHSESPSRLPINRSGTWKREHSKHSSSLPRVSTWRRTGSSSSILSASSESSEKAKSEDEKHVNSISGTKQSKENQVSAKGTWRKIKENEFSPTNSTSQTVSSGATNGAESKTLIYQMAPAVSKTEDVWVRIEDCPINNPRSGRSPTGNTPPVIDSVSEKANPNIKDSKDNQAKQNVGNGSVPMRTVGLENRLNSFIQVDAPDQKGTEIKPGQNNPVPVSETNESSIVERTPFSSSSSSKHSSPSGTVAARVTPFNYNPSPRKSSADSTSARPSQIPTPVNNNTKKRDSKTDSTESSGTQSPKRHSGSYLVTSV

SEQ ID NO: 43 - protein, 1863 aa, Homo sapiens
MDLSALRVEEVQNVINAMQKILECPICLELIKEPVSTKCDHIFCKFCMLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLQETSLSVQLSNLGTVRTLRTKQRIQPQKTSVYIELGSDSSEDTVNKATYCSVGDQELLQITPQGTRDEISLDSAKKAACEFSETDVTNTEHHQPSNNDLNTTEKRAAERHPEKYQGSSVSNLHVEPCGTNTHASSLQHENSSLLLTKDRMNVEKAEFCNKSKQPGLARSQHNRWAGSKETCNDRRTPSTEKKVDLNADPLCERKEWNKQKLPCSENPRDTEDVPWITLNSSIQKVNEWFSRSDELLGSDDSHDGESESNAKVADVLDVLNEVDEYSGSSEKIDLLASDPHEALICKSERVHSKSVESNIEDKIFGKTYRKKASLPNLSHVTENLIIGAFVTEPQIIQERPLTNKLKRKRRPTSGLHPEDFIKKADLAVQKTPEMINQGTNQTEQNGQVMNITNSGHENKTKGDSIQNEKNPNPIESLEKESAFKTKAEPISSSISNMELELNIHNSKAPKKNRLRRKSSTRHIHALELVVSRNLSPPNCTELQIDSCSSSEEIKKKKYNQMPVRHSRNLQLMEGKEPATGAKKSNKPNEQTSKRHDSDTFPELKLTNAPGSFTKCSNTSELKEFVNPSLPREEKEEKLETVKVSNNAEDPKDLMLSGERVLQTERSVESSSISLVPGTDYGTQESISLLEVSTLGKAKTEPNKCVSQCAAFENPKGLIHGCSKDNRNDTEGFKYPLGHEVNHSRETSIEMEESELDAQYLQNTFKVSKRQSFAPFSNPGNAEEECATFSAHSGSLKKQSPKVTFECEQKEENQGKNESNIKPVQTVNITAGFPVVGQKDKPVDNAKCSIKGGSRFCLSSQFRGNETGLITPNKHGLLQNPYRIPPLFPIKSFVKTKCKKNLLEENFEEHSMSPEREMGNENIPSTVSTISRNNIRENVFKEASSSNINEVGSSTNEVGSSINEIGSSDENIQAELGRNRGPKLNAMLRLGVLQPEVYKQSLPGSNCKHPEIKKQEYEEVVQTVNTDFSPYLISDNLEQPMGSSHASQVCSETPDDLLDDGEIKEDTSFAENDIKESSAVFSKSVQKGELSRSPSPFTHTHLAQGYRRGAKKLESSEENLSSEDEELPCFQHLLFGKVNNIPSQSTRHSTVATECLSKNTEENLLSLKNSLNDCSNQVILAKASQEHHLSEETKCSASLFSSQCSELEDLTANTNTQDPFLIGSSKQMRHQSESQGVGLSDKELVSDDEERGTGLEENNQEEQSMDSNLGEAASGCESETSVSEDCSGLSSQSDILTTQQRDTMQHNLIKLQQEMAELEAVLEQHGSQPSNSYPSIISDSSALEDLRNPEQSTSEKAVLTSQKSSEYPISQNPEGLSADKFEVSADSSTSKNKEPGVERSSPSKCPSLDDRWYMHSCSGSLQNRNYPSQEELIKVVDVEEQQLEESGPHDLTETSYLPRQDLEGTPYLESGISLFSDDPESDPSEDRAPESARVGNIPSSTSALKVPQLKVAESAQSPAAAHTTDTAGYNAMEESVSREKPELTASTERVNKRMSMVVSGLTPEEFMLVYKFARKHHITLTNLITEETTHVVMKTDAEFVCERTLKYFLGIAGGKWVVSYFWVTQSIKERKMLNEHDFEVRGDVVNGRNHQGPKRARESQDRKIFRGLEICCYGPFTNMPTDQLEWMVQLCGASVVKELSSFTLGTGVHPIVVVQPDAWTEDNGFHAIGQMCEAPVVTREWVLDSVALYQCQELDTYLIPQIPHSHY

SEQ ID NO: 44 - protein, 3418 aa, Homo sapiens
MPIGSKERPTFFEIFKTRCNKADLGPISLNWFEELSSEAPPYNSEPAEESEHKNNNYEPNLFKTPQRKPSYNQLASTPIIFKEQGLTLPLYQSPVKELDKFKLDLGRNVPNSRHKSLRTVKTKMDQADDVSCPLLNSCLSESPVVLQCTHVTPQRDKSVVCGSLFHTPKFVKGRQTPKHISESLGAEVDPDMSWSSSLATPPTLSSTVLIVRNEEASETVFPHDTTANVKSYFSNHDESLKKNDRFIASVTDSENTNQREAASHGFGKTSGNSFKVNSCKDHIGKSMPNVLEDEVYETVVDTSEEDSFSLCFSKCRTKNLQKVRTSKTRKKIFHEANADECEKSKNQVKEKYSFVSEVEPNDTDPLDSNVANQKPFESGSDKISKEVVPSLACEWSQLTLSGLNGAQMEKIPLLHISSCDQNISEKDLLDTENKRKKDFLTSENSLPRISSLPKSEKPLNEETVVNKRDEEQHLESHTDCILAVKQAISGTSPVASSFQGIKKSIFRIRESPKETFNASFSGHMTDPNFKKETEASESGLEIHTVCSQKEDSLCPNLIDNGSWPATTTQNSVALKNAGLISTLKKKTNKFIYAIHDETSYKGKKIPKDQKSELINCSAQFEANAFEAPLTFANADSGLLHSSVKRSCSQNDSEEPTLSLTSSFGTILRKCSRNETCSNNTVISQDLDYKEAKCNKEKLQLFITPEADSLSCLQEGQCENDPKSKKVSDIKEEVLAAACHPVQHSKVEYSDTDFQSQKSLLYDHENASTLILTPTSKDVLSNLVMISRGKESYKMSDKLKGNNYESDVELTKNIPMEKNQDVCALNENYKNVELLPPEKYMRVASPSRKVQFNQNTNLRVIQKNQEETTSISKITVNPDSEELFSDNENNFVFQVANERNNLALGNTKELHETDLTCVNEPIFKNSTMVLYGDTGDKQATQVSIKKDLVYVLAEENKNSVKQHIKMTLGQDLKSDISLNIDKIPEKNNDYMNKWAGLLGPISNHSFGGSFRTASNKEIKLSEHNIKKSKMFFKDIEEQYPTSLACVEIVNTLALDNQKKLSKPQSINTVSAHLQSSVVVSDCKNSHITPQMLFSKQDFNSNHNLTPSQKAEITELSTILEESGSQFEFTQFRKPSYILQKSTFEVPENQMTILKTTSEECRDADLHVIMNAPSIGQVDSSKQFEGTVEIKRKFAGLLKNDCNKSASGYLTDENEVGFRGFYSAHGTKLNVSTEALQKAVKLFSDIENISEETSAEVHPISLSSSKCHDSVVSMFKIENHNDKTVSEKNNKCQLILQNNIEMTTGTFVEEITENYKRNTENEDNKYTAASRNSHNLEFDGSDSSKNDTVCIHKDETDLLFTDQHNICLKLSGQFMKEGNTQIKEDLSDLTFLEVAKAQEACHGNTSNKEQLTATKTEQNIKDFETSDTFFQTASGKNISVAKESFNKIVNFFDQKPEELHNFSLNSELHSDIRKNKMDILSYEETDIVKHKILKESVPVGTGNQLVTFQGQPERDEKIKEPTLLGFHTASGKKVKIAKESLDKVKNLFDEKEQGTSEITSFSHQWAKTLKYREACKDLELACETIEITAAPKCKEMQNSLNNDKNLVSIETVVPPKLLSDNLCRQTENLKTSKSIFLKVKVHENVEKETAKSPATCYTNQSPYSVIENSALAFYTSCSRKTSVSQTSLLEAKKWLREGIFDGQPERINTADYVGNYLYENNSNSTIAENDKNHLSEKQDTYLSNSSMSNSYSYHSDEVYNDSGYLSKNKLDSGIEPVLKNVEDQKNTSFSKVISNVKDANAYPQTVNEDICVEELVTSSSPCKNKNAAIKLSISNSNNFEVGPPAFRIASGKIVCVSHETIKKVKDIFTDSFSKVIKENNENKSKICQTKIMAGCYEALDDSEDILHNSLDNDECSTHSHKVFADIQSEEILQHNQNMSGLEKVSKISPCDVSLETSDICKCSIGKLHKSVSSANTCGIFSTASGKSVQVSDASLQNARQVFSEIEDSTKQVFSKVLFKSNEHSDQLTREENTAIRTPEHLISQKGFSYNVVNSSAFSGFSTASGKQVSILESSLHKVKGVLEEFDLIRTEHSLHYSPTSRQNVSKILPRVDKRNPEHCVNSEMEKTCSKEFKLSNNLNVEGGSSENNHSIKVSPYLSQFQQDKQQLVLGTKVSLVENIHVLGKEQASPKNVKMEIGKTETFSDVPVKTNIEVCSTYSKDSENYFETEAVEIAKAFMEDDELTDSKLPSHATHSLFTCPENEEMVLSNSRIGKRRGEPLILVGEPSIKRNLLNEFDRIIENQEKSLKASKSTPDGTIKDRRLFMHHVSLEPITCVPFRTTKERQEIQNPNFTAPGQEFLSKSHLYEHLTLEKSSSNLAVSGHPFYQVSATRNEKMRHLITTGRPTKVFVPPFKTKSHFHRVEQCVRNINLEENRQKQNIDGHGSDDSKNKINDNEIHQFNKNNSNQAAAVTFTKCEEEPLDLITSLQNARDIQDMRIKKKQRQRVFPQPGSLYLAKTSTLPRISLKAAVGGQVPSACSHKQLYTYGVSKHCIKINSKNAESFQFHTEDYFGKESLWTGKGIQLADGGWLIPSNDGKAGKEEFYRALCDTPGVDPKLISRIWVYNHYRWIIWKLAAMECAFPKEFANRCLSPERVLLQLKYRYDTEIDRSRRSAIKKIMERDDTAAKTLVLCVSDIISLSANISETSSNKTSSADTQKVAIIELTDGWYAVKAQLDPPLLAVLKNGRLTVGQKIILHGAELVGSPDACTPLEAPESLMLKISANSTRPARWYTKLGFFPDPRPFPLPLSSLFSDGGNVGCVDVIIQRAYPIQWMEKTSSGLYIFRNEREEEKEAAKYVEAQQKRLEALFTKIQEEFEEHEENTTKPYLPSRALTRQQVRALQDGAELYEAVKNAADPAYLEGYFSEEQLRALNNHRQMLNDKKQAQIQLEIRKAMESAEQKEQGLSRDVTTVWKLRIVSYSKKEKDSVILSIWRPSSDLYSLLTEGKRYRIYHLATSKSKSKSERANIQLAATKKTQYQQLPVSDEILFQIYQPREPLHFSKFLDPDFQPSCSEVDLIGFVVSVVKKTGLAPFVYLSDECYNLLAIKFWIDLNEDIIKPHMLIAASNLQWRPESKSGLLTLFAGDFSVFSASPKEGHFQETFNKMKNTVENIDILCNEAENKLMHILHANDPKWSTPTKDCTSGPYTAQIIPGTGNKLLMSSPNCEIYYQSPLSLCMAKRKSVSTPVSAQMTSKSCKGEKEIDDQKNCKKRRALDFLSRLPLPPPVSPICTFVSPAAQKAFQPPRSCGTKYETPIKKKELNSPQMTPFKKFNEISLLESNSIADEELALINTQALLSGSTGEKQFISVSESTRTAPTSSEDYLRLKRRCTTSLIKEQESSQASTEECEKNKQDTITTKKYI

SEQ ID NO: 45 - protein, 393 aa, Homo sapiens [sequence omitted]

SEQ ID NO: 46 - protein, 770 aa, Homo sapiens
MLPGLALLLLAAWTARALEVPTDGNAGLLAEPQIAMFCGRLNMHMNVQNGKWDSDPSGTKTCIDTKEGILQYCQEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVREVCSEQAETGPCRAMISRWYFDVTEGKCAPFFYGGCGGNRNNFDTEEYCMAVCGSAMSQSLLKTTQEPLARDPVKLPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPRHVFNMLKKYVRAEQKDRQHTLKHFEHVRMVDPKKAAQIRSQVMTHLRVIYERMNQSLSLLYNVPAVAEEIQDEVDELLQKEQNYSDDVLANMISEPRISYGNDALMPSLTETKTTVELLPVNGEFSLDDLQPWHSFGADSVPANTENEVEPVDARPAADRGLTTRPGSGLTNIKTEEISEVKMDAEFRHDSGYEVHHQKLVFFAEDVGSNKGAIIGLMVGGVVIATVIVITLVMLKKKQYTSIHHGVVEVDAAVTPEERHLSKMQQNGYENPTYKFFEQMQN

SEQ ID NO: 47 - protein, 3144 aa, Homo sapiens
MATLEKLMKAFESLKSFQQQQQQQQQQQQQQQQQQQQQQQPPPPPPPPPPPQLPQPPPQAQPLLPQPQPPPPPPPPPPGPAVAEEPLHRPKKELSATKKDRVNHCLTICENIVAQSVRNSPEFQKLLGIAMELFLLCSDDAESDVRMVADECLNKVIKALMDSNLPRLQLELYKEIKKNGAPRSLRAALWRFAELAHLVRPQKCRPYLVNLLPCLTRTSKRPEESVQETLAAAVPKIMASFGNFANDNEIKVLLKAFIANLKSSSPTIRRTAAGSAVSICQHSRRTQYFYSWLLNVLLGLLVPVEDEHSTLLILGVLLTLRYLVPLLQQQVKDTSLKGSFGVTRKEMEVSPSAEQLVQVYELTLHHTQHQDHNVVTGALELLQQLFRTPPPELLQTLTAVGGIGQLTAAKEESGGRSRSGSIVELIAGGGSSCSPVLSRKQKGKVLLGEEEALEDDSESRSDVSSSALTASVKDEISGELAASSGVSTPGSAGHDIITEQPRSQHTLQADSVDLASCDLTSSATDGDEEDILSHSSSQVSAVPSDPAMDLNDGTQASSPISDSSQTTTEGPDSAVTPSDSSEIVLDGTDNQYLGLQIGQPQDEDEEATGILPDEASEAFRNSSMALQQAHLLKNMSHCRQPSDSSVDKFVLRDEATEPGDQENKPCRIKGDIGQSTDDDSAPLVHCVRLLSASFLLTGGKNVLVPDRDVRVSVKALALSCVGAAVALHPESFFSKLYKVPLDTTEYPEEQYVSDILNYIDHGDPQVRGATAILCGTLICSILSRSRFHVGDWMGTIRTLTGNTFSLADCIPLLRKTLKDESSVTCKLACTAVRNCVMSLCSSSYSELGLQLIIDVLTLRNSSYWLVRTELLETLAEIDFRLVSFLEAKAENLHRGAHHYTGLLKLQERVLNNVVIHLLGDEDPRVRHVAAASLIRLVPKLFYKCDQGQADPVVAVARDQSSVYLKLLMHETQPPSHFSVSTITRIYRGYNLLPSITDVTMENNLSRVIAAVSHELITSTTRALTFGCCEALCLLSTAFPVCIWSLGWHCGVPPLSASDESRKSCTVGMATMILTLLSSAWFPLDLSAHQDALILAGNLLAASAPKSLRSSWASEEEANPAATKQEEVWPALGDRALVPMVEQLFSHLLKVINICAHVLDDVAPGPAIKAALPSLTNPPSLSPIRRKGKEKEPGEQASVPLSPKKGSEASAASRQSDTSGPVTTSKSSSLGSFYHLPSYLKLHDVLKATHANYKVTLDLQNSTEKFGGFLRSALDVLSQILELATLQDIGKCVEEILGYLKSCFSREPMMATVCVQQLLKTLFGTNLASQFDGLSSNPSKSQGRAQRLGSSSVRPGLYHYCFMAPYTHFTQALADASLRNMVQAEQENDTSGWFDVLQKVSTQLKTNLTSVTKNRADKNAIHNHIRLFEPLVIKALKQYTTTTCVQLQKQVLDLLAQLVQLRVNYCLLDSDQVFIGFVLKQFEYIEVGQFRESEAIIPNIFFFLVLLSYERYHSKQIIGIPKIIQLCDGIMASGRKAVTHAIPALQPIVHDLFVLRGTNKADAGKELETQKEVVVSMLLRLIQYHQVLEMFILVLQQCHKENEDKWKRLSRQIADIILPMLAKQQMHIDSHEALGVLNTLFEILAPSSLRPVDMLLRSMFVTPNTMASVSTVQLWISGILAILRVLISQSTEDIVLSRIQELSFSPYLISCTVINRLRDGDSTSTLEEHSEGKQIKNLPEETFSRFLLQLVGILLEDIVTKQLKVEMSEQQHTFYCQELGTLLMCLIHIFKSGMFRRITAAATRLFRSDGCGGSFYTLDSLNLRARSMITTHPALVLLWCQILLLVNHTDYRWWAEVQQTPKRHSLSSTKLLSPQMSGEEEDSDLAAKLGMCNREIVRRGALILFCDYVCQNLHDSEHLTWLIVNHIQDLISLSHEPPVQDFISAVHRNSAASGLFIQAIQSRCENLSTPTMLKKTLQCLEGIHLSQSGAVLTLYVDRLLCTPFRVLARMVDILACRRVEMLLAANLQSSMAQLPMEELNRIQEYLQSSGLAQRHQRLYSLLDRFRLSTMQDSLSPSPPVSSHPLDGDGHVSLETVSPDKDWYVHLVKSQCWTRSDSALLEGAELVNRIPAEDMNAFMMNSEFNLSLLAPCLSLGMSEISGGQKSALFEAAREVTLARVSGTVQQLPAVHHVFQPELPAEPAAYWSKLNDLFGDAALYQSLPTLARALAQYLVVVSKLPSHLHLPPEKEKDIVKFVVATLEALSWHLIHEQIPLSLDLQAGLDCCCLALQLPGLWSVVSSTEFVTHACSLIYCVHFILEAVAVQPGEQLLSPERRTNTPKAISEEEEEVDPNTQNPKYITAACEMVAEMVESLQSVLALGHKRNSGVPAFLTPLLRNIIISLARLPLVNSYTRVPPLVWKLGWSPKPGGDFGTAFPEIPVEFLQEKEVFKEFIYRINTLGWTSRTQFEETWATLLGVLVTQPLVMEQEESPPEEDTERTQINVLAVQAITSLVLSAMTVPVAGNPAVSCLEQQPRNKPLKALDTRFGRKLSIIRGIVEQEIQAMVSKRENIATHHLYQAWDPVPSLSPATTGALISHEKLLLQINPERELGSMSYKLGQVSIHSVWLGNSITPLREEEWDEEEEEEADAPAPSSPPTSPVNSRKHRAGVDIHSCSQFLLELYSRWILPSSSARRTPAILISEVVRSLLVVSDLFTERNQFELMYVTLTELRRVHPSEDEILAQYLVPATCKAAAVLGMDKAVAEPVSRLLESTLRSSHLPSRVGALHGVLYVLECDLLDDTAKQLIPVISDYLLSNLKGIAHCVNIHSQQHVLVMCATAFYLIENYPLDVGPEFSASIIQMCGVMLSGSEESTPSIIYHCALRGLERLLLSEQLSRLDAESLVKLSVDRVNVHSPHRAMAALGLMLTCMYTGKEKVSPGRTSDPNPAAPDSESVIVAMERVSVLFDRIRKGFPCEARVVARILPQFLDDFFPPQDIMNKVIGEFLSNQQPYPQFMATVVYKVFQTLHSTGQSSMVRDWVMLSLSNFTQRAPVAMATWSLSCFFVSASTSPWVAAILPHVISRMGKLEQVDVNLFCLVATDFYRHQIEEELDRRAFQSVLEVVAAPGSPYHRLLTCLRNVHKVTTC

SEQ ID NO: 48 - protein, 89 aa, Homo sapiens
MGILKLQVFLIVLSVALNHLKATPIESHQVEKRKCNTATCATQRLANFLVHSSNNFGAILSSTNVGSNTYGKRNAVEVLKREPLNYLPL

SEQ ID NO: 49 - protein, 776 aa, Homo sapiens
MAEPRQEFEVMEDHAGTYGLGDRKDQGGYTMHQDQEGDTDAGLKESPLQTPTEDGSEEPGSETSDAKSTPTAEDVTAPLVDEGAPGKQAAAQPHTEIPEGTTAEEAGIGDTPSLEDEAAGHVTQEPESGKVVQEGFLREPGPPGLSHQLMSGMPGAPLLPEGPREATRQPSGTGPEDTEGGRHAPELLKHQLLGDLHQEGPPLKGAGGKERPGSKEEVDEDRDVDESSPQDSPPSKASPAQDGRPPQTAAREATSIPGFPAEGAIPLPVDFLSKVSTEIPASEPDGPSVGRAKGQDAPLEFTFHVEITPNVQKEQAHSEEHLGRAAFPGAPGEGPEARGPSLGEDTKEADLPEPSEKQPAAAPRGKPVSRVPQLKARMVSKSKDGTGSDDKKAKTSTRSSAKTLKNRPCLSPKHPTPGSSDPLIQPSSPAVCPEPPSSPKYVSSVTSRTGSSGAKEMKLKGADGKTKIATPRGAAPPGQKGQANATRIPAKTPPAPKTPPSSATKQVQRRPPPAGPRSERGEPPKSGDRSGYSSPGSPGTPGSRSRTPSLPTPPTREPKKVAVVRTPPKSPSSAKSRLQTAPVPMPDLKNVKSKIGSTENLKHQPGGGKVQIINKKLDLSNVQSKCGSKDNIKHVPGGGSVQIVYKPVDLSKVTSKCGSLGNIHHKPGGGQVEVKSEKLDFKDRVQSKIGSLDNITHVPGGGNKKIETHKLTFRENAKAKTDHGAEIVYKSPVVSGDTSPRHLSNVSSTGSIDMVDSPQLATLADEVSASLAKQGL

SEQ ID NO: 50 - protein, 253 aa, Homo sapiens
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGGYMLGSAMSRPIIHFGSDYEDRYYRENMHRYPNQVYYRPMDEYSNQNNFVHDCVNITIKQHTVTTTTKGENFTETDVKMMERVVEQMCITQYERESQAYYQRGSSMVLFSSPPVILLISFLIFLIVG

SEQ ID NO: 51 - protein, 140 aa, Homo sapiens
MDVFMKGLSKAKEGVVAAAEKTKQGVAEAAGKTKEGVLYVGSKTKEGVVHGVATVAEKTKEQVTNVGGAVVTGVTAVAQKTVEGAGSIAAATGFVKKDQLGKNEEGAPQEGILEDMPVDPDNEAYEMPSEEGYQDYEPEA

SEQ ID NO: 52 - protein, 140 aa, Homo sapiens; identical to SEQ ID NO: 51

SEQ ID NO: 53 - protein, 196 aa, Homo sapiens
QLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINF

SEQ ID NO: 54 - protein, 36 aa, Homo sapiens
  misc_feature (12)..(13): Xaa can be any naturally occurring amino acid
LTPEQVVAIASXXGGKQALETVQRLLPVLCQAHGGG

SEQ ID NO: 55 - protein, 36 aa, Homo sapiens
  misc_feature (12)..(13): Xaa can be any naturally occurring amino acid
LTPEQVVAIASXXGGKQALETVQRLLPVLCQAGHGG

SEQ ID NO: 56 - protein, 36 aa, Homo sapiens
  misc_feature (12)..(13): Xaa can be any naturally occurring amino acid
LTPEQVVAIASXXGGKQALETVQRLLPVLCQAHGSG

SEQ ID NO: 57 - protein, 1089 aa, Homo sapiens
  misc_feature (188)..(189): Xaa can be any naturally occurring amino acid
  misc_feature (224)..(225): Xaa can be any naturally occurring amino acid
  misc_feature (258)..(259): Xaa can be any naturally occurring amino acid
  misc_feature (294)..(295): Xaa can be any naturally occurring amino acid
  misc_feature (328)..(329): Xaa can be any naturally occurring amino acid
  misc_feature (364)..(365): Xaa can be any naturally occurring amino acid
  misc_feature (398)..(399): Xaa can be any naturally occurring amino acid
  misc_feature (434)..(435): Xaa can be any naturally occurring amino acid
  misc_feature (468)..(469): Xaa can be any naturally occurring amino acid
  misc_feature (504)..(505): Xaa can be any naturally occurring amino acid
  misc_feature (538)..(539): Xaa can be any naturally occurring amino acid
  misc_feature (574)..(575): Xaa can be any naturally occurring amino acid
  misc_feature (608)..(609): Xaa can be any naturally occurring amino acid
  misc_feature (644)..(645): Xaa can be any naturally occurring amino acid
  misc_feature (678)..(679): Xaa can be any naturally occurring amino acid
  misc_feature (714)..(715): Xaa can be any naturally occurring amino acid
  misc_feature (748)..(749): Xaa can be any naturally occurring amino acid
  misc_feature (784)..(785): Xaa can be any naturally occurring amino acid
  misc_feature (818)..(819): Xaa can be any naturally occurring amino acid
MDYKDHDGDYKDHDIDYKDDDDKMAPKKKRKVGIHGVPAAVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASXXGGKQALETVQRLLPVLCQAGHGGLTPEQVVAIASXXGGKQALETVQRLLPVLCQAHGLTPEQVVAIASXXGGKQALETVQRLLPVLCQAGHGGLTPEQVVAIASXXGGKQALETVQRLLPVLCQAHGLTPEQVVAIASXXGGKQALETVQRLLPVLCQAGHGGLTPEQVVAIASXXGGKQALETVQRLLPVLCQAHGLTPEQVVAIASXXGGKQALETVQRLLPVLCQAGHGGLTPEQVVAIASXXGGKQALETVQRLLPVLCQAHGLTPEQVVAIASXXGGKQALETVQRLLPVLCQAGHGGLTPEQVVAIASXXGGKQALETVQRLLPVLCQAHGLTPEQVVAIASXXGGKQALETVQRLLPVLCQAGHGGLTPEQVVAIASXXGGKQALETVQRLLPVLCQAHGLTPEQVVAIASXXGGKQALETVQRLLPVLCQAGHGGLTPEQVVAIASXXGGKQALETVQRLLPVLCQAHGLTPEQVVAIASXXGGKQALETVQRLLPVLCQAGHGGLTPEQVVAIASXXGGKQALETVQRLLPVLCQAHGLTPEQVVAIASXXGGKQALETVQRLLPVLCQAGHGGLTPEQVVAIASXXGGKQALETVQRLLPVLCQAHGLTPEQVVAIASXXGGRPALESIVAQLSRPDPALAALTNDHLVALACLGGRPALDAVKKGLPHAPALIKRTNRRIPERTSHRVAGSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFRS

SEQ ID NO: 58 - protein, 1107 aa, Homo sapiens
  misc_feature (188)..(189): Xaa can be any naturally occurring amino acid
  misc_feature (224)..(225): Xaa can be any naturally occurring amino acid
  misc_feature (260)..(261): Xaa can be any naturally occurring amino acid
  misc_feature (296)..(297): Xaa can be any naturally occurring amino acid
  misc_feature (332)..(333): Xaa can be any naturally occurring amino acid
  misc_feature (368)..(369): Xaa can be any naturally occurring amino acid
  misc_feature (404)..(405): Xaa can be any naturally occurring amino acid
  misc_feature (440)..(441): Xaa can be any naturally occurring amino acid
  misc_feature (476)..(477): Xaa can be any naturally occurring amino acid
  misc_feature (512)..(513): Xaa can be any naturally occurring amino acid
  misc_feature (548)..(549): Xaa can be any naturally occurring amino acid
  misc_feature (584)..(585): Xaa can be any naturally occurring amino acid
  misc_feature (620)..(621): Xaa can be any naturally occurring amino acid
  misc_feature (656)..(657): Xaa can be any naturally occurring amino acid
  misc_feature (692)..(693): Xaa can be any naturally occurring amino acid
  misc_feature (728)..(729): Xaa can be any naturally occurring amino acid
  misc_feature (764)..(765): Xaa can be any naturally occurring amino acid
  misc_feature (800)..(801): Xaa can be any naturally occurring amino acid
  misc_feature (836)..(837): Xaa can be any naturally occurring amino acid
MDYKDHDGDYKDHDIDYKDDDDKMAPKKKRKVGIHGVPAAVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGRPALESIVAQLSRPDPALAALTNDHLVALACLGGRPALDAVKKGLPHAPALIKRTNRRIPERTSHRVAGSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFRS

SEQ ID NO: 59 - protein, 1086 aa, Homo sapiens
  misc_feature (188)..(189): Xaa can be any naturally occurring amino acid
  misc_feature (224)..(225): Xaa can be any naturally occurring amino acid
  misc_feature (258)..(259): Xaa can be any naturally occurring amino acid
  misc_feature (294)..(295): Xaa can be any naturally occurring amino acid
  misc_feature (328)..(329): Xaa can be any naturally occurring amino acid
  misc_feature (364)..(365): Xaa can be any naturally occurring amino acid
  misc_feature (398)..(399): Xaa can be any naturally occurring amino acid
  misc_feature (434)..(435): Xaa can be any naturally occurring amino acid
  misc_feature (468)..(469): Xaa can be any naturally occurring amino acid
  misc_feature (504)..(505): Xaa can be any naturally occurring amino acid
  misc_feature (538)..(539): Xaa can be any naturally occurring amino acid
  misc_feature (574)..(575): Xaa can be any naturally occurring amino acid
  misc_feature (608)..(609): Xaa can be any naturally occurring amino acid
  misc_feature (644)..(645): Xaa can be any naturally occurring amino acid
  misc_feature (678)..(679): Xaa can be any naturally occurring amino acid
  misc_feature (714)..(715): Xaa can be any naturally occurring amino acid
  misc_feature (748)..(749): Xaa can be any naturally occurring amino acid
  misc_feature (784)..(785): Xaa can be any naturally occurring amino acid
  misc_feature (818)..(819): Xaa can be any naturally occurring amino acid
MDYKDHDGDYKDHDIDYKDDDDKMAPKKKRKVGIHGVPAAVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASXXGGKQALETVQRLLPVLCQAGHGGLTPEQVVAIASXXGGKQALETVQRLLPVLCQAHGLTPEQVVAIASXXGGKQALETVQRLLPVLCQAGHGGLTPEQVVAIASXXGGKQALETVQRLLPVLCQAHGLTPEQVVAIASXXGGKQALETVQRLLPVLCQAGHGGLTPEQVVAIASXXGGKQALETVQRLLPVLCQAHGLTPEQVVAIASXXGGKQALETVQRLLPVLCQAGHGGLTPEQVVAIASXXGGKQALETVQRLLPVLCQAHGLTPEQVVAIASXXGGKQALETVQRLLPVLCQAGHGGLTPEQVVAIASXXGGKQALETVQRLLPVLCQAHGLTPEQVVAIASXXGGKQALETVQRLLPVLCQAGHGGLTPEQVVAIASXXGGKQALETVQRLLPVLCQAHGLTPEQVVAIASXXGGKQALETVQRLLPVLCQAGHGGLTPEQVVAIASXXGGKQALETVQRLLPVLCQAHGLTPEQVVAIASXXGGKQALETVQRLLPVLCQAGHGGLTPEQVVAIASXXGGKQALETVQRLLPVLCQAHGLTPEQVVAIASXXGGKQALETVQRLLPVLCQAGHGGLTPEQVVAIASXXGGKQALETVQRLLPVLCQAHGLTPEQVVAIASXXGGRPALESIVAQLSRPDPALAALTNDHLVALACLGGRPALDAVKKGLPHAPALIKRTNRRIPERTSHRVAGSVLEKSDIEKFKNQLRTELTNIDHSYLKGIDIASKKKTSNVENTEFEAISTKIFTDELGFSGKHLGGSNKPDGLLWDDDCAIILDSKAYSEGFPLTASHTDAMGRYLRQFTERKEEIKPTWWDIAPEHLDNTYFAYVSGSFSGNYKEQLQKFRQDTNHLGGALEFVKLLLLANNYKTQKMSKKEVKKSILDYNISY

SEQ ID NO: 60 - protein, 1104 aa, Homo sapiens
  misc_feature (188)..(189): Xaa can be any naturally occurring amino acid
  misc_feature (224)..(225): Xaa can be any naturally occurring amino acid
  misc_feature (260)..(261): Xaa can be any naturally occurring amino acid
  misc_feature (296)..(297): Xaa can be any naturally occurring amino acid
  misc_feature (332)..(333): Xaa can be any naturally occurring amino acid
  misc_feature (368)..(369): Xaa can be any naturally occurring amino acid
  misc_feature (404)..(405): Xaa can be any naturally occurring amino acid
  misc_feature (440)..(441): Xaa can be any naturally occurring amino acid
  misc_feature (476)..(477): Xaa can be any naturally occurring amino acid
  misc_feature (512)..(513): Xaa can be any naturally occurring amino acid
  misc_feature (548)..(549): Xaa can be any naturally occurring amino acid
  misc_feature (584)..(585): Xaa can be any naturally occurring amino acid
  misc_feature (620)..(621): Xaa can be any naturally occurring amino acid
  misc_feature (656)..(657): Xaa can be any naturally occurring amino acid
  misc_feature (692)..(693): Xaa can be any naturally occurring amino acid
  misc_feature (728)..(729): Xaa can be any naturally occurring amino acid
  misc_feature (764)..(765): Xaa can be any naturally occurring amino acid
  misc_feature (800)..(801): Xaa can be any naturally occurring amino acid
  misc_feature (836)..(837): Xaa can be any naturally occurring amino acid
MDYKDHDGDYKDHDIDYKDDDDKMAPKKKRKVGIHGVPAAVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGKQALETVQRLLPVLCQAGHGGLTPEQVVAIASXXGGRPALESIVAQLSRPDPALAALTNDHLVALACLGGRPALDAVKKGLPHAPALIKRTNRRIPERTSHRVAGSVLEKSDIEKFKNQLRTELTNIDHSYLKGIDIASKKKTSNVENTEFEAISTKIFTDELGFSGKHLGGSNKPDGLLWDDDCAIILDSKAYSEGFPLTASHTDAMGRYLRQFTERKEEIKPTWWDIAPEHLDNTYFAYVSGSFSGNYKEQLQKFRQDTNHLGGALEFVKLLLLANNYKTQKMSKKEVKKSILDYNISY

SEQ ID NO: 61 - protein, 1464 aa, Homo sapiens
MFSFVDLRLLLLLAATALLTHGQEEGQVEGQDEDIPPITCVQNGLRYHDRDVWKPEPCRICVCDNGKVLCDDVICDETKNCPGAEVPEGECCPVCPDGSESPTDQETTGVEGPKGDTGPRGPRGPAGPPGRDGIPGQPGLPGPPGPPGPPGPPGLGGNFAPQLSYGYDEKSTGGISVPGPMGPSGPRGLPGPPGAPGPQGFQGPPGEPGEPGASGPMGPRGPPGPPGKNGDDGEAGKPGRPGERGPPGPQGARGLPGTAGLPGMKGHRGFSGLDGAKGDAGPAGPKGEPGSPGENGAPGQMGPRGLPGERGRPGAPGPAGARGNDGATGAAGPPGPTGPAGPPGFPGAVGAKGEAGPQGPRGSEGPQGVRGEPGPPGPAGAAGPAGNPGADGQPGAKGANGAPGIAGAPGFPGARGPSGPQGPGGPPGPKGNSGEPGAPGSKGDTGAKGEPGPVGVQGPPGPAGEEGKRGARGEPGPTGLPGPPGERGGPGSRGFPGADGVAGPKGPAGERGSPGPAGPKGSPGEAGRPGEAGLPGAKGLTGSPGSPGPDGKTGPPGPAGQDGRPGPPGPPGARGQAGVMGFPGPKGAAGEPGKAGERGVPGPPGAVGPAGKDGEAGAQGPPGPAGPAGERGEQGPAGSPGFQGLPGPAGPPGEAGKPGEQGVPGDLGAPGPSGARGERGFPGERGVQGPPGPAGPRGANGAPGNDGAKGDAGAPGAPGSQGAPGLQGMPGERGAAGLPGPKGDRGDAGPKGADGSPGKDGVRGLTGPIGPPGPAGAPGDKGESGPSGPAGPTGARGAPGDRGEPGPPGPAGFAGPPGADGQPGAKGEPGDAGAKGDAGPPGPAGPAGPPGPIGNVGAPGAKGARGSAGPPGATGFPGAAGRVGPPGPSGNAGPPGPPGPAGKEGGKGPRGETGPAGRPGEVGPPGPPGPAGEKGSPGADGPAGAPGTPGPQGIAGQRGVVGLPGQRGERGFPGLPGPSGEPGKQGPSGASGERGPPGPMGPPGLAGPPGESGREGAPGAEGSPGRDGSPGAKGDRGETGPAGPPGAPGAPGAPGPVGPAGKSGDRGETGPAGPAGPVGPVGARGPAGPQGPRGDKGETGEQGDRGIKGHRGFSGLQGPPGPPGSPGEQGPSGASGPAGPRGPPGSAGAPGKDGLNGLPGPIGPPGPRGRTGDAGPVGPPGPPGPPGPPGPPSAGFDFSFLPQPPQEKAHDGGRYYRADDANVVRDRDLEVDTTLKSLSQQIENIRSPEGSRKNPARTCRDLKMCHSDWKSGEYWIDPNQGCNLDAIKVFCNMETGETCVYPTQPSVAQKNWYISKNPKDKRHVWFGESMTDGFQFEYGGQGSDPADVAIQLTFLRLMSTEASQNITYHCKNSVAYMDQQTGNLKKALLLQGSNEIEIRAEGNSRFTYSVTVDGCTSHTGAWGKTVIEYKTTKTSRLPIIDVAPLDVGAPDQEFGFDVGPVCFL

SEQ ID NO: 62 - protein, 1366 aa, Homo sapiens
MLSFVDTRTLLLLAVTLCLATCQSLQEETVRKGPAGDRGPRGERGPPGPPGRDGEDGPTGPPGPPGPPGPPGLGGNFAAQYDGKGVGLGPGPMGLMGPRGPPGAAGAPGPQGFQGPAGEPGEPGQTGPAGARGPAGPPGKAGEDGHPGKPGRPGERGVVGPQGARGFPGTPGLPGFKGIRGHNGLDGLKGQPGAPGVKGEPGAPGENGTPGQTGARGLPGERGRVGAPGPAGARGSDGSVGPVGPAGPIGSAGPPGFPGAPGPKGEIGAVGNAGPAGPAGPRGEVGLPGLSGPVGPPGNPGANGLTGAKGAAGLPGVAGAPGLPGPRGIPGPVGAAGATGARGLVGEPGPAGSKGESGNKGEPGSAGPQGPPGPSGEEGKRGPNGEAGSAGPPGPPGLRGSPGSRGLPGADGRAGVMGPPGSRGASGPAGVRGPNGDAGRPGEPGLMGPRGLPGSPGNIGPAGKEGPVGLPGIDGRPGPIGPAGARGEPGNIGFPGPKGPTGDPGKNGDKGHAGLAGARGAPGPDGNNGAQGPPGPQGVQGGKGEQGPPGPPGFQGLPGPSGPAGEVGKPGERGLHGEFGLPGPAGPRGERGPPGESGAAGPTGPIGSRGPSGPPGPDGNKGEPGVVGAVGTAGPSGPSGLPGERGAAGIPGGKGEKGEPGLRGEIGNPGRDGARGAPGAVGAPGPAGATGDRGEAGAAGPAGPAGPRGSPGERGEVGPAGPNGFAGPAGAAGQPGAKGERGAKGPKGENGVVGPTGPVGAAGPAGPNGPPGPAGSRGDGGPPGMTGFPGAAGRTGPPGPSGISGPPGPPGPAGKEGLRGPRGDQGPVGRTGEVGAVGPPGFAGEKGPSGEAGTAGPPGTPGPQGLLGAPGILGLPGSRGERGLPGVAGAVGEPGPLGIAGPPGARGPPGAVGSPGVNGAPGEAGRDGNPGNDGPPGRDGQPGHKGERGYPGNIGPVGAAGAPGPHGPVGPAGKHGNRGETGPSGPVGPAGAVGPRGPSGPQGIRGDKGEPGEKGPRGLPGLKGHNGLQGLPGIAGHHGDQGAPGSVGPAGPRGPAGPSGPAGKDGRTGHPGTVGPAGIRGPQGHQGPAGPPGPPGPPGPPGVSGGGYDFGYDGDFYRADQPRSAPSLRPKDYEVDATLKSLNNQIETLLTPEGSRKNPARTCRDLRLSHPEWSSGYYWIDPNQGCTMDAIKVYCDFSTGETCIRAQPENIPAKNWYRSSKDKKHVWLGETINAGSQFEYNVEGVTSKEMATQLAFMRLLANYASQNITYHCKNSIAYMDEETGNLKKAVILQGSNDVELVAEGNSRFTYTVLVDGCSKKTNEWGKTIIEYKTNKPSRLPFLDIAPLDIGGADQEFFVDIGPVCFK

SEQ ID NO: 63 - protein, 1487 aa, Homo sapiens
MIRLGAPQTLVLLTLLVAAVLRCQGQDVQEAGSCVQDGQRYNDKDVWKPEPCRICVCDTGTVLCDDIICEDVKDCLSPEIPFGECCPICPTDLATASGQPGPKGQKGEPGDIKDIVGPKGPPGPQGPAGEQGPRGDRGDKGEKGAPGPRGRDGEPGTPGNPGPPGPPGPPGPPGLGGNFAAQMAGGFDEKAGGAQLGVMQGPMGPMGPRGPPGPAGAPGPQGFQGNPGEPGEPGVSGPMGPRGPPGPPGKPGDDGEAGKPGKAGERGPPGPQGARGFPGTPGLPGVKGHRGYPGLDGAKGEAGAPGVKGESGSPGENGSPGPMGPRGLPGERGRTGPAGAAGARGNDGQPGPAGPPGPVGPAGGPGFPGAPGAKGEAGPTGARGPEGAQGPRGEPGTPGSPGPAGASGNPGTDGIPGAKGSAGAPGIAGAPGFPGPRGPPGPQGATGPLGPKGQTGEPGIAGFKGEQGPKGEPGPAGPQGAPGPAGEEGKRGARGEPGGVGPIGPPGERGAPGNRGFPGQDGLAGPKGAPGERGPSGLAGPKGANGDPGRPGEPGLPGARGLTGRPGDAGPQGKVGPSGAPGEDGRPGPPGPQGARGQPGVMGFPGPKGANGEPGKAGEKGLPGAPGLRGLPGKDGETGAAGPPGPAGPAGERGEQGAPGPSGFQGLPGPPGPPGEGGKPGDQGVPGEAGAPGLVGPRGERGFPGERGSPGAQGLQGPRGLPGTPGTDGPKGASGPAGPPGAQGPPGLQGMPGERGAAGIAGPKGDRGDVGEKGPEGAPGKDGGRGLTGPIGPPGPAGANGEKGEVGPPGPAGSAGARGAPGERGETGPPGPAGFAGPPGADGQPGAKGEQGEAGQKGDAGAPGPQGPSGAPGPQGPTGVTGPKGARGAQGPPGATGFPGAAGRVGPPGSNGNPGPPGPPGPSGKDGPKGARGDSGPPGRAGEPGLQGPAGPPGEKGEPGDDGPSGAEGPPGPQGLAGQRGIVGLPGQRGERGFPGLPGPSGEPGKQGAPGASGDRGPPGPVGPPGLTGPAGEPGREGSPGADGPPGRDGAAGVKGDRGETGAVGAPGAPGPPGSPGPAGPTGKQGDRGEAGAQGPMGPSGPAGARGIQGPQGPRGDKGEAGEPGERGLKGHRGFTGLQGLPGPPGPSGDQGASGPAGPSGPRGPPGPVGPSGKDGANGIPGPIGPPGPRGRSGETGPAGPPGNPGPPGPPGPPGPGIDMSAFAGLGPREKGPDPLQYMRADQAAGGLRQHDAEVDATLKSLNNQIESIRSPEGSRKNPARTCRDLKLCHPEWKSGDYWIDPNQGCTLDAMKVFCNMETGETCVYPNPANVPKKNWWSSKSKEKKHIWFGETINGGFHFSYGDDNLAPNTANVQMTFLRLLSTEGSQNITYHCKNSIAYLDEAAGNLKKALLIQGSNDVEIRAEGNSRFTYTALKDGCTKHTGKWGKTVIEYRSQKTSRLPIIDIAPMDIGGPEQEFGVDIGPVCFL

SEQ ID NO: 64 - protein, 1418 aa, Homo sapiens
MIRLGAPQTLVLLTLLVAAVLRCQGQDVRQPGPKGQKGEPGDIKDIVGPKGPPGPQGPAGEQGPRGDRGDKGEKGAPGPRGRDGEPGTPGNPGPPGPPGPPGPPGLGGNFAAQMAGGFDEKAGGAQLGVMQGPMGPMGPRGPPGPAGAPGPQGFQGNPGEPGEPGVSGPMGPRGPPGPPGKPGDDGEAGKPGKAGERGPPGPQGARGFPGTPGLPGVKGHRGYPGLDGAKGEAGAPGVKGESGSPGENGSPGPMGPRGLPGERGRTGPAGAAGARGNDGQPGPAGPPGPVGPAGGPGFPGAPGAKGEAGPTGARGPEGAQGPRGEPGTPGSPGPAGASGNPGTDGIPGAKGSAGAPGIAGAPGFPGPRGPPGPQGATGPLGPKGQTGEPGIAGFKGEQGPKGEPGPAGPQGAPGPAGEEGKRGARGEPGGVGPIGPPGERGAPGNRGFPGQDGLAGPKGAPGERGPSGLAGPKGANGDPGRPGEPGLPGARGLTGRPGDAGPQGKVGPSGAPGEDGRPGPPGPQGARGQPGVMGFPGPKGANGEPGKAGEKGLPGAPGLRGLPGKDGETGAAGPPGPAGPAGERGEQGAPGPSGFQGLPGPPGPPGEGGKPGDQGVPGEAGAPGLVGPRGERGFPGERGSPGAQGLQGPRGLPGTPGTDGPKGASGPAGPPGAQGPPGLQGMPGERGAAGIAGPKGDRGDVGEKGPEGAPGKDGGRGLTGPIGPPGPAGANGEKGEVGPPGPAGSAGARGAPGERGETGPPGPAGFAGPPGADGQPGAKGEQGEAGQKGDAGAPGPQGPSGAPGPQGPTGVTGPKGARGAQGPPGATGFPGAAGRVGPPGSNGNPGPPGPPGPSGKDGPKGARGDSGPPGRAGEPGLQGPAGPPGEKGEPGDDGPSGAEGPPGPQGLAGQRGIVGLPGQRGERGFPGLPGPSGEPGKQGAPGASGDRGPPGPVGPPGLTGPAGEPGREGSPGADGPPGRDGAAGVKGDRGETGAVGAPGAPGPPGSPGPAGPTGKQGDRGEAGAQGPMGPSGPAGARGIQGPQGPRGDKGEAGEPGERGLKGHRGFTGLQGLPGPPGPSGDQGASGPAGPSGPRGPPGPVGPSGKDGANGIPGPIGPPGPRGRSGETGPAGPPGNPGPPGPPGPPGPGIDMSAFAGLGPREKGPDPLQYMRADQAAGGLRQHDAEVDATLKSLNNQIESIRSPEGSRKNPARTCRDLKLCHPEWKSGDYWIDPNQGCTLDAMKVFCNMETGETCVYPNPANVPKKNWWSSKSKEKKHIWFGETINGGFHFSYGDDNLAPNTANVQMTFLRLLSTEGSQNITYHCKNSIAYLDEAAGNLKKALLIQGSNDVEIRAEGNSRFTYTALKDGCTKHTGKWGKTVIEYRSQKTSRLPIIDIAPMDIGGPEQEFGVDIGPVCFL

SEQ ID NO: 65 - protein, 1466 aa, Homo sapiens
MMSFVQKGSWLLLALLHPTIILAQQEAVEGGCSHLGQSYADRDVWKPEPCQICVCDSGSVLCDDIICDDQELDCPNPEIPFGECCAVCPQPPTAPTRPPNGQGPQGPKGDPGPPGIPGRNGDPGIPGQPGSPGSPGPPGICESCPTGPQNYSPQYDSYDVKSGVAVGGLAGYPGPAGPPGPPGPPGTSGHPGSPGSPGYQGPPGEPGQAGPSGPPGPPGAIGPSGPAGKDGESGRPGRPGERGLPGPPGIKGPAGIPGFPGMKGHRGFDGRNGEKGETGAPGLKGENGLPGENGAPGPMGPRGAPGERGRPGLPGAAGARGNDGARGSDGQPGPPGPPGTAGFPGSPGAKGEVGPAGSPGSNGAPGQRGEPGPQGHAGAQGPPGPPGINGSPGGKGEMGPAGIPGAPGLMGARGPPGPAGANGAPGLRGGAGEPGKNGAKGEPGPRGERGEAGIPGVPGAKGEDGKDGSPGEPGANGLPGAAGERGAPGFRGPAGPNGIPGEKGPAGERGAPGPAGPRGAAGEPGRDGVPGGPGMRGMPGSPGGPGSDGKPGPPGSQGESGRPGPPGPSGPRGQPGVMGFPGPKGNDGAPGKNGERGGPGGPGPQGPPGKNGETGPQGPPGPTGPGGDKGDTGPPGPQGLQGLPGTGGPPGENGKPGEPGPKGDAGAPGAPGGKGDAGAPGERGPPGLAGAPGLRGGAGPPGPEGGKGAAGPPGPPGAAGTPGLQGMPGERGGLGSPGPKGDKGEPGGPGADGVPGKDGPRGPTGPIGPPGPAGQPGDKGEGGAPGLPGIAGPRGSPGERGETGPPGPAGFPGAPGQNGEPGGKGERGAPGEKGEGGPPGVAGPPGGSGPAGPPGPQGVKGERGSPGGPGAAGFPGARGLPGPPGSNGNPGPPGPSGSPGKDGPPGPAGNTGAPGSPGVSGPKGDAGQPGEKGSPGAQGPPGAPGPLGIAGITGARGLAGPPGMPGPRGSPGPQGVKGESGKPGANGLSGERGPPGPQGLPGLAGTAGEPGRDGNPGSDGLPGRDGSPGGKGDRGENGSPGAPGAPGHPGPPGPVGPAGKSGDRGESGPAGPAGAPGPAGSRGAPGPQGPRGDKGETGERGAAGIKGHRGFPGNPGAPGSPGPAGQQGAIGSPGPAGPRGPVGPSGPPGKDGTSGHPGPIGPPGPRGNRGERGSEGSPGHPGQPGPPGPPGAPGPCCGGVGAAAIAGIGGEKAGGFAPYYGDEPMDFKINTDEIMTSLKSVNGQIESLISPDGSRKNPARNCRDLKFCHPELKSGEYWVDPNQGCKLDAIKVFCNMETGETCISANPLNVPRKHWWTDSSAEKKHVWFGESMDGGFQFSYGNPELPEDVLDVQLAFLRLLSSRASQNITYHCKNSIAYMDQASGNVKKALKLMGSNEGEFKAEGNSKFTYTVLEDGCTKHTGEWSKTVFEYRTRKAVRLPIVDIAPYDIGGPDQEFGVDVGPVCFL

SEQ ID NO: 66 - protein, 1669 aa, Homo sapiens
MGPRLSVWLLLLPAALLLHEEHSRAAAKGGCAGSGCGKCDCHGVKGQKGERGLPGLQGVIGFPGMQGPEGPQGPPGQKGDTGEPGLPGTKGTRGPPGASGYPGNPGLPGIPGQDGPPGPPGIPGCNGTKGERGPLGPPGLPGFAGNPGPPGLPGMKGDPGEILGHVPGMLLKGERGFPGIPGTPGPPGLPGLQGPVGPPGFTGPPGPPGPPGPPGEKGQMGLSFQGPKGDKGDQGVSGPPGVPGQAQVQEKGDFATKGEKGQKGEPGFQGMPGVGEKGEPGKPGPRGKPGKDGDKGEKGSPGFPGEPGYPGLIGRQGPQGEKGEAGPPGPPGIVIGTGPLGEKGERGYPGTPGPRGEPGPKGFPGLPGQPGPPGLPVPGQAGAPGFPGERGEKGDRGFPGTSLPGPSGRDGLPGPPGSPGPPGQPGYTNGIVECQPGPPGDQGPPGIPGQPGFIGEIGEKGQKGESCLICDIDGYRGPPGPQGPPGEIGFPGQPGAKGDRGLPGRDGVAGVPGPQGTPGLIGQPGAKGEPGEFYFDLRLKGDKGDPGFPGQPGMTGRAGSPGRDGHPGLPGPKGSPGSVGLKGERGPPGGVGFPGSRGDTGPPGPPGYGPAGPIGDKGQAGFPGGPGSPGLPGPKGEPGKIVPLPGPPGAEGLPGSPGFPGPQGDRGFPGTPGRPGLPGEKGAVGQPGIGFPGPPGPKGVDGLPGDMGPPGTPGRPGFNGLPGNPGVQGQKGEPGVGLPGLKGLPGLPGIPGTPGEKGSIGVPGVPGEHGAIGPPGLQGIRGEPGPPGLPGSVGSPGVPGIGPPGARGPPGGQGPPGLSGPPGIKGEKGFPGFPGLDMPGPKGDKGAQGLPGITGQSGLPGLPGQQGAPGIPGFPGSKGEMGVMGTPGQPGSPGPVGAPGLPGEKGDHGFPGSSGPRGDPGLKGDKGDVGLPGKPGSMDKVDMGSMKGQKGDQGEKGQIGPIGEKGSRGDPGTPGVPGKDGQAGQPGQPGPKGDPGISGTPGAPGLPGPKGSVGGMGLPGTPGEKGVPGIPGPQGSPGLPGDKGAKGEKGQAGPPGIGIPGLRGEKGDQGIAGFPGSPGEKGEKGSIGIPGMPGSPGLKGSPGSVGYPGSPGLPGEKGDKGLPGLDGIPGVKGEAGLPGTPGPTGPAGQKGEPGSDGIPGSAGEKGEPGLPGRGFPGFPGAKGDKGSKGEVGFPGLAGSPGIPGSKGEQGFMGPPGPQGQPGLPGSPGHATEGPKGDRGPQGQPGLPGLPGPMGPPGLPGIDGVKGDKGNPGWPGAPGVPGPKGDPGFQGMPGIGGSPGITGSKGDMGPPGVPGFQGPKGLPGLQGIKGDQGDQGVPGAKGLPGPPGPPGPYDIIKGEPGLPGPEGPPGLKGLQGLPGPKGQQGVTGLVGIPGPPGIPGFDGAPGQKGEMGPAGPTGPRGFPGPPGPDGLPGSMGPPGTPSVDHGFLVTRHSQTIDDPQCPSGTKILYHGYSLLYVQGNERAHGQDLGTAGSCLRKFSTMPFLFCNINNVCNFASRNDYSYWLSTPEPMPMSMAPITGENIRPFISRCAVCEAPAMVMAVHSQTIQIPPCPSGWSSLWIGYSFVMHTSAGAEGSGQALASPGSCLEEFRSAPFIECHGRGTCNYYANAYSFWLATIERSEMFKKPTPSTLKAGELRTHVSRCQVCMRRT

SEQ ID NO: 67 - protein, 1712 aa, Homo sapiens
MGRDQRAVAGPALRRWLLLGTVTVGFLAQSVLAGVKKFDVPCGGRDCSGGCQCYPEKGGRGQPGPVGPQGYNGPPGLQGFPGLQGRKGDKGERGAPGVTGPKGDVGARGVSGFPGADGIPGHPGQGGPRGRPGYDGCNGTQGDSGPQGPPGSEGFTGPPGPQGPKGQKGEPYALPKEERDRYRGEPGEPGLVGFQGPPGRPGHVGQMGPVGAPGRPGPPGPPGPKGQQGNRGLGFYGVKGEKGDVGQPGPNGIPSDTLHPIIAPTGVTFHPDQYKGEKGSEGEPGIRGISLKGEEGIMGFPGLRGYPGLSGEKGSPGQKGSRGLDGYQGPDGPRGPKGEAGDPGPPGLPAYSPHPSLAKGARGDPGFPGAQGEPGSQGEPGDPGLPGPPGLSIGDGDQRRGLPGEMGPKGFIGDPGIPALYGGPPGPDGKRGPPGPPGLPGPPGPDGFLFGLKGAKGRAGFPGLPGSPGARGPKGWKGDAGECRCTEGDEAIKGLPGLPGPKGFAGINGEPGRKGDRGDPGQHGLPGFPGLKGVPGNIGAPGPKGAKGDSRTITTKGERGQPGVPGVPGMKGDDGSPGRDGLDGFPGLPGPPGDGIKGPPGDPGYPGIPGTKGTPGEMGPPGLGLPGLKGQRGFPGDAGLPGPPGFLGPPGPAGTPGQIDCDTDVKRAVGGDRQEAIQPGCIGGPKGLPGLPGPPGPTGAKGLRGIPGFAGADGGPGPRGLPGDAGREGFPGPPGFIGPRGSKGAVGLPGPDGSPGPIGLPGPDGPPGERGLPGEVLGAQPGPRGDAGVPGQPGLKGLPGDRGPPGFRGSQGMPGMPGLKGQPGLPGPSGQPGLYGPPGLHGFPGAPGQEGPLGLPGIPGREGLPGDRGDPGDTGAPGPVGMKGLSGDRGDAGFTGEQGHPGSPGFKGIDGMPGTPGLKGDRGSPGMDGFQGMPGLKGRPGFPGSKGEAGFFGIPGLKGLAGEPGFKGSRGDPGPPGPPPVILPGMKDIKGEKGDEGPMGLKGYLGAKGIQGMPGIPGLSGIPGLPGRPGHIKGVKGDIGVPGIPGLPGFPGVAGPPGITGFPGFIGSRGDKGAPGRAGLYGEIGATGDFGDIGDTINLPGRPGLKGERGTTGIPGLKGFFGEKGTEGDIGFPGITGVTGVQGPPGLKGQTGFPGLTGPPGSQGELGRIGLPGGKGDDGWPGAPGLPGFPGLRGIRGLHGLPGTKGFPGSPGSDIHGDPGFPGPPGERGDPGEANTLPGPVGVPGQKGDQGAPGERGPPGSPGLQGFPGITPPSNISGAPGDKGAPGIFGLKGYRGPPGPPGSAALPGSKGDTGNPGAPGTPGTKGWAGDSGPQGRPGVFGLPGEKGPRGEQGFMGNTGPTGAVGDRGPKGPKGDPGFPGAPGTVGAPGIAGIPQKIAVQPGTVGPQGRRGPPGAPGEMGPQGPPGEPGFRGAPGKAGPQGRGGVSAVPGFRGDEGPIGHQGPIGQEGAPGRPGSPGLPGMPGRSVSIGYLLVKHSQTDQEPMCPVGMNKLWSGYSLLYFEGQEKAHNQDLGLAGSCLARFSTMPFLYCNPGDVCYYASRNDKSYWLSTTAPLPMMPVAEDEIKPYISRCSVCEAPAIAIAVHSQDVSIPHCPAGWRSLWIGYSFLMHTAAGDEGGGQSLVSPGSCLEDFRATPFIECNGGRGTCHYYANKYSFWLTTIPEQSFQGSPSADTLKAGLIRTHISRCQVCMKNL

SEQ ID NO: 68 - protein, 1670 aa, Homo sapiens
MSARTAPRPQVLLLPLLLVLLAAAPAASKGCVCKDKGQCFCDGAKGEKGEKGFPGPPGSPGQKGFTGPEGLPGPQGPKGFPGLPGLTGSKGVRGISGLPGFSGSPGLPGTPGNTGPYGLVGVPGCSGSKGEQGFPGLPGTLGYPGIPGAAGLKGQKGAPAKEEDIELDAKGDPGLPGAPGPQGLPGPPGFPGPVGPPGPPGFFGFPGAMGPRGPKGHMGERVIGHKGERGVKGLTGPPGPPGTVIVTLTGPDNRTDLKGEKGDKGAMGEPGPPGPSGLPGESYGSEKGAPGDPGLQGKPGKDGVPGFPGSEGVKGNRGFPGLMGEDGIKGQKGDIGPPGFRGPTEYYDTYQEKGDEGTPGPPGPRGARGPQGPSGPPGVPGSPGSSRPGLRGAPGWPGLKGSKGERGRPGKDAMGTPGSPGCAGSPGLPGSPGPPGPPGDIVFRKGPPGDHGLPGYLGSPGIPGVDGPKGEPGLLCTQCPYIPGPPGLPGLPGLHGVKGIPGRQGAAGLKGSPGSPGNTGLPGFPGFPGAQGDPGLKGEKGETLQPEGQVGVPGDPGLRGQPGRKGLDGIPGTPGVKGLPGPKGELALSGEKGDQGPPGDPGSPGSPGPAGPAGPPGYGPQGEPGLQGTQGVPGAPGPPGEAGPRGELSVSTPVPGPPGPPGPPGHPGPQGPPGIPGSLGKCGDPGLPGPDGEPGIPGIGFPGPPGPKGDQGFPGTKGSLGCPGKMGEPGLPGKPGLPGAKGEPAVAMPGGPGTPGFPGERGNSGEHGEIGLPGLPGLPGTPGNEGLDGPRGDPGQPGPPGEQGPPGRCIEGPRGAQGLPGLNGLKGQQGRRGKTGPKGDPGIPGLDRSGFPGETGSPGIPGHQGEMGPLGQRGYPGNPGILGPPGEDGVIGMMGFPGAIGPPGPPGNPGTPGQRGSPGIPGVKGQRGTPGAKGEQGDKGNPGPSEISHVIGDKGEPGLKGFAGNPGEKGNRGVPGMPGLKGLKGLPGPAGPPGPRGDLGSTGNPGEPGLRGIPGSMGNMGMPGSKGKRGTLGFPGRAGRPGLPGIHGLQGDKGEPGYSEGTRPGPPGPTGDPGLPGDMGKKGEMGQPGPPGHLGPAGPEGAPGSPGSPGLPGKPGPHGDLGFKGIKGLLGPPGIRGPPGLPGFPGSPGPMGIRGDQGRDGIPGPAGEKGETGLLRAPPGPRGNPGAQGAKGDRGAPGFPGLPGRKGAMGDAGPRGPTGIEGFPGPPGLPGAIIPGQTGNRGPPGSRGSPGAPGPPGPPGSHVIGIKGDKGSMGHPGPKGPPGTAGDMGPPGRLGAPGTPGLPGPRGDPGFQGFPGVKGEKGNPGFLGSIGPPGPIGPKGPPGVRGDPGTLKIISLPGSPGPPGTPGEPGMQGEPGPPGPPGNLGPCGPRGKPGKDGKPGTPGPAGEKGNKGSKGEPGPAGSDGLPGLKGKRGDSGSPATWTTRGFVFTRHSQTTAIPSCPEGTVPLYSGFSFLFVQGNQRAHGQDLGTLGSCLQRFTTMPFLFCNVNDVCNFASRNDYSYWLSTPALMPMNMAPITGRALEPYISRCTVCEGPAIAIAVHSQTTDIPPCPHGWISLWKGFSFIMFTSAGSEGTGQALASPGSCLEEFRASPFLECHGRGTCNYYSNSYSFWLASLNPERMFRKPIPSTVKAGELEKIISRCQVCMKKRH

SEQ ID NO: 69 - protein, 1690 aa, Homo sapiens
MWSLHIVLMRCSFRLTKSLATGPWSLILILFSVQYVYGSGKKYIGPCGGRDCSVCHCVPEKGSRGPPGPPGPQGPIGPLGAPGPIGLSGEKGMRGDRGPPGAAGDKGDKGPTGVPGFPGLDGIPGHPGPPGPRGKPGMSGHNGSRGDPGFPGGRGALGPGGPLGHPGEKGEKGNSVFILGAVKGIQGDRGDPGLPGLPGSWGAGGPAGPTGYPGEPGLVGPPGQPGRPGLKGNPGVGVKGQMGDPGEVGQQGSPGPTLLVEPPDFCLYKGEKGIKGIPGMVGLPGPPGRKGESGIGAKGEKGIPGFPGPRGDPGSYGSPGFPGLKGELGLVGDPGLFGLIGPKGDPGNRGHPGPPGVLVTPPLPLKGPPGDPGFPGRYGETGDVGPPGPPGLLGRPGEACAGMIGPPGPQGFPGLPGLPGEAGIPGRPDSAPGKPGKPGSPGLPGAPGLQGLPGSSVIYCSVGNPGPQGIKGKVGPPGGRGPKGEKGNEGLCACEPGPMGPPGPPGLPGRQGSKGDLGLPGWLGTKGDPGPPGAEGPPGLPGKHGASGPPGNKGAKGDMVVSRVKGHKGERGPDGPPGFPGQPGSHGRDGHAGEKGDPGPPGDHEDATPGGKGFPGPLGPPGKAGPVGPPGLGFPGPPGERGHPGVPGHPGVRGPDGLKGQKGDTISCNVTYPGRHGPPGFDGPPGPKGFPGPQGAPGLSGSDGHKGRPGTPGTAEIPGPPGFRGDMGDPGFGGEKGSSPVGPPGPPGSPGVNGQKGIPGDPAFGHLGPPGKRGLSGVPGIKGPRGDPGCPGAEGPAGIPGFLGLKGPKGREGHAGFPGVPGPPGHSCERGAPGIPGQPGLPGYPGSPGAPGGKGQPGDVGPPGPAGMKGLPGLPGRPGAHGPPGLPGIPGPFGDDGLPGPPGPKGPRGLPGFPGFPGERGKPGAEGCPGAKGEPGEKGMSGLPGDRGLRGAKGAIGPPGDEGEMAIISQKGTPGEPGPPGDDGFPGERGDKGTPGMQGRRGEPGRYGPPGFHRGEPGEKGQPGPPGPPGPPGSTGLRGFIGFPGLPGDQGEPGSPGPPGFSGIDGARGPKGNKGDPASHFGPPGPKGEPGSPGCPGHFGASGEQGLPGIQGPRGSPGRPGPPGSSGPPGCPGDHGMPGLRGQPGEMGDPGPRGLQGDPGIPGPPGIKGPSGSPGLNGLHGLKGQKGTKGASGLHDVGPPGPVGIPGLKGERGDPGSPGISPPGPRGKKGPPGPPGSSGPPGPAGATGRAPKDIPDPGPPGDQGPPGPDGPRGAPGPPGLPGSVDLLRGEPGDCGLPGPPGPPGPPGPPGYKGFPGCDGKDGQKGPVGFPGPQGPHGFPGPPGEKGLPGPPGRKGPTGLPGPRGEPGPPADVDDCPRIPGLPGAPGMRGPEGAMGLPGMRGPSGPGCKGEPGLDGRRGVDGVPGSPGPPGRKGDTGEDGYPGGPGPPGPIGDPGPKGFGPGYLGGFLLVLHSQTDQEPTCPLGMPRLWTGYSLLYLEGQEKAHNQDLGLAGSCLPVFSTLPFAYCNIHQVCHYAQRNDRSYWLASAAPLPMMPLSEEAIRPYVSRCAVCEAPAQAVAVHSQDQSIPPCPQTWRSLWIGYSFLMHTGAGDQGGGQALMSPGSCLEDFRAAPFLECQGRQGTCHFFANKYSFWLTTVKADLQFSSAPAPDTLKESQAQRQKISRCQVCVKYS

SEQ ID NO: 70 - protein, 1685 aa, Homo sapiens
MKLRGVSLAAGLFLLALSLWGQPAEAAACYGCSPGSKCDCSGIKGEKGERGFPGLEGHPGLPGFPGPEGPPGPRGQKGDDGIPGPPGPKGIRGPPGLPGFPGTPGLPGMPGHDGAPGPQGIPGCNGTKGERGFPGSPGFPGLQGPPGPPGIPGMKGEPGSIIMSSLPGPKGNPGYPGPPGIQGLPGPTGIPGPIGPPGPPGLMGPPGPPGLPGPKGNMGLNFQGPKGEKGEQGLQGPPGPPGQISEQKRPIDVEFQKGDQGLPGDRGPPGPPGIRGPPGPPGGEKGEKGEQGEPGKRGKPGKDGENGQPGIPGLPGDPGYPGEPGRDGEKGQKGDTGPPGPPGLVIPRPGTGITIGEKGNIGLPGLPGEKGERGFPGIQGPPGLPGPPGAAVMGPPGPPGFPGERGQKGDEGPPGISIPGPPGLDGQPGAPGLPGPPGPAGPHIPPSDEICEPGPPGPPGSPGDKGLQGEQGVKGDKGDTCFNCIGTGISGPPGQPGLPGLPGPPGSLGFPGQKGEKGQAGATGPKGLPGIPGAPGAPGFPGSKGEPGDILTFPGMKGDKGELGSPGAPGLPGLPGTPGQDGLPGLPGPKGEPGGITFKGERGPPGNPGLPGLPGNIGPMGPPGFGPPGPVGEKGIQGVAGNPGQPGIPGPKGDPGQTITQPGKPGLPGNPGRDGDVGLPGDPGLPGQPGLPGIPGSKGEPGIPGIGLPGPPGPKGFPGIPGPPGAPGTPGRIGLEGPPGPPGFPGPKGEPGFALPGPPGPPGLPGFKGALGPKGDRGFPGPPGPPGRTGLDGLPGPKGDVGPNGQPGPMGPPGLPGIGVQGPPGPPGIPGPIGQPGLHGIPGEKGDPGPPGLDVPGPPGERGSPGIPGAPGPIGPPGSPGLPGKAGASGFPGTKGEMGMMGPPGPPGPLGIPGRSGVPGLKGDDGLQGQPGLPGPTGEKGSKGEPGLPGPPGPMDPNLLGSKGEKGEPGLPGIPGVSGPKGYQGLPGDPGQPGLSGQPGLPGPPGPKGNPGLPGQPGLIGPPGLKGTIGDMGFPGPQGVEGPPGPSGVPGQPGSPGLPGQKGDKGDPGISSIGLPGLPGPKGEPGLPGYPGNPGIKGSVGDPGLPGLPGTPGAKGQPGLPGFPGTPGPPGPKGISGPPGNPGLPGEPGPVGGGGHPGQPGPPGEKGKPGQDGIPGPAGQKGEPGQPGFGNPGPPGLPGLSGQKGDGGLPGIPGNPGLPGPKGEPGFHGFPGVQGPPGPPGSPGPALEGPKGNPGPQGPPGRPGLPGPEGPPGLPGNGGIKGEKGNPGQPGLPGLPGLKGDQGPPGLQGNPGRPGLNGMKGDPGLPGVPGFPGMKGPSGVPGSAGPEGEPGLIGPPGPPGLPGPSGQSIIIKGDAGPPGIPGQPGLKGLPGPQGPQGLPGPTGPPGDPGRNGLPGFDGAGGRKGDPGLPGQPGTRGLDGPPGPDGLQGPPGPPGTSSVAHGFLITRHSQTTDAPQCPQGTLQVYEGFSLLYVQGNKRAHGQDLGTAGSCLRRFSTMPFMFCNINNVCNFASRNDYSYWLSTPEPMPMSMQPLKGQSIQPFISRCAVCEAPAVVIAVHSQTIQIPHCPQGWDSLWIGYSFMMHTSAGAEGSGQALASPGSCLEEFRSAPFIECHGRGTCNYYANSYSFWLATVDVSDMFSKPQSETLKAGDLRTRISRCQVCMKRT

SEQ ID NO: 71 - protein, 1691 aa, Homo sapiens
MLINKLWLLLVTLCLTEELAAAGEKSYGKPCGGQDCSGSCQCFPEKGARGRPGPIGIQGPTGPQGFTGSTGLSGLKGERGFPGLLGPYGPKGDKGPMGVPGFLGINGIPGHPGQPGPRGPPGLDGCNGTQGAVGFPGPDGYPGLLGPPGLPGQKGSKGDPVLAPGSFKGMKGDPGLPGLDGITGPQGAPGFPGAVGPAGPPGLQGPPGPPGPLGPDGNMGLGFQGEKGVKGDVGLPGPAGPPPSTGELEFMGFPKGKKGSKGEPGPKGFPGISGPPGFPGLGTTGEKGEKGEKGIPGLPGPRGPMGSEGVQGPPGQQGKKGTLGFPGLNGFQGIEGQKGDIGLPGPDVFIDIDGAVISGNPGDPGVPGLPGLKGDEGIQGLRGPSGVPGLPALSGVPGALGPQGFPGLKGDQGNPGRTTIGAAGLPGRDGLPGPPGPPGPPSPEFETETLHNKESGFPGLRGEQGPKGNLGLKGIKGDSGFCACDGGVPNTGPPGEPGPPGPWGLIGLPGLKGARGDRGSGGAQGPAGAPGLVGPLGPSGPKGKKGEPILSTIQGMPGDRGDSGSQGFRGVIGEPGKDGVPGLPGLPGLPGDGGQGFPGEKGLPGLPGEKGHPGPPGLPGNGLPGLPGPRGLPGDKGKDGLPGQQGLPGSKGITLPCIIPGSYGPSGFPGTPGFPGPKGSRGLPGTPGQPGSSGSKGEPGSPGLVHLPELPGFPGPRGEKGLPGFPGLPGKDGLPGMIGSPGLPGSKGATGDIFGAENGAPGEQGLQGLTGHKGFLGDSGLPGLKGVHGKPGLLGPKGERGSPGTPGQVGQPGTPGSSGPYGIKGKSGLPGAPGFPGISGHPGKKGTRGKKGPPGSIVKKGLPGLKGLPGNPGLVGLKGSPGSPGVAGLPALSGPKGEKGSVGFVGFPGIPGLPGIPGTRGLKGIPGSTGKMGPSGRAGTPGEKGDRGNPGPVGIPSPRRPMSNLWLKGDKGSQGSAGSNGFPGPRGDKGEAGRPGPPGLPGAPGLPGIIKGVSGKPGPPGFMGIRGLPGLKGSSGITGFPGMPGESGSQGIRGSPGLPGASGLPGLKGDNGQTVEISGSPGPKGQPGESGFKGTKGRDGLIGNIGFPGNKGEDGKVGVSGDVGLPGAPGFPGVAGMRGEPGLPGSSGHQGAIGPLGSPGLIGPKGFPGFPGLHGLNGLPGTKGTHGTPGPSITGVPGPAGLPGPKGEKGYPGIGIGAPGKPGLRGQKGDRGFPGLQGPAGLPGAPGISLPSLIAGQPGDPGRPGLDGERGRPGPAGPPGPPGPSSNQGDTGDPGFPGIPGPKGPKGDQGIPGFSGLPGELGLKGMRGEPGFMGTPGKVGPPGDPGFPGMKGKAGPRGSSGLQGDPGQTPTAEAVQVPPGPLGLPGIDGIPGLTGDPGAQGPVGLQGSKGLPGIPGKDGPSGLPGPPGALGDPGLPGLQGPPGFEGAPGQQGPFGMPGMPGQSMRVGYTLVKHSQSEQVPPCPIGMSQLWVGYSLLFVEGQEKAHNQDLGFAGSCLPRFSTMPFIYCNINEVCHYARRNDKSYWLSTTAPIPMMPVSQTQIPQYISRCSVCEAPSQAIAVHSQDITIPQCPLGWRSLWIGYSFLMHTAAGAEGGGQSLVSPGSCLEDFRATPFIECSGARGTCHYFANKYSFWLTTVEERQQFGELPVSETLKAGQLHTRVSRCQVCMKSL

SEQ ID NO: 72 - protein, 1838 aa, Homo sapiens
MDVHTRWKARSALRPGAPLLPPLLLLLLWAPPPSRAAQPADLLKVLDFHNLPDGITKTTGFCATRRSSKGPDVAYRVTKDAQLSAPTKQLYPASAFPEDFSILTTVKAKKGSQAFLVSIYNEQGIQQIGLELGRSPVFLYEDHTGKPGPEDYPLFRGINLSDGKWHRIALSVHKKNVTLILDCKKKTTKFLDRSDHPMIDINGIIVFGTRILDEEVFEGDIQQLLFVSDHRAAYDYCEHYSPDCDTAVPDTPQSQDPNPDEYYTEGDGEGETYYYEYPYYEDPEDLGKEPTPSKKPVEAAKETTEVPEELTPTPTEAAPMPETSEGAGKEEDVGIGDYDYVPSEDYYTPSPYDDLTYGEGEENPDQPTDPGAGAEIPTSTADTSNSSNPAPPPGEGADDLEGEFTEETIRNLDENYYDPYYDPTSSPSEIGPGMPANQDTIYEGIGGPRGEKGQKGEPAIIEPGMLIEGPPGPEGPAGLPGPPGTMGPTGQVGDPGERGPPGRPGLPGADGLPGPPGTMLMLPFRFGGGGDAGSKGPMVSAQESQAQAILQQARLALRGPAGPMGLTGRPGPVGPPGSGGLKGEPGDVGPQGPRGVQGPPGPAGKPGRRGRAGSDGARGMPGQTGPKGDRGFDGLAGLPGEKGHRGDPGPSGPPGPPGDDGERGDDGEVGPRGLPGEPGPRGLLGPKGPPGPPGPPGVTGMDGQPGPKGNVGPQGEPGPPGQQGNPGAQGLPGPQGAIGPPGEKGPLGKPGLPGMPGADGPPGHPGKEGPPGEKGGQGPPGPQGPIGYPGPRGVKGADGIRGLKGTKGEKGEDGFPGFKGDMGIKGDRGEIGPPGPRGEDGPEGPKGRGGPNGDPGPLGPPGEKGKLGVPGLPGYPGRQGPKGSIGFPGFPGANGEKGGRGTPGKPGPRGQRGPTGPRGERGPRGITGKPGPKGNSGGDGPAGPPGERGPNGPQGPTGFPGPKGPPGPPGKDGLPGHPGQRGETGFQGKTGPPGPPGVVGPQGPTGETGPMGERGHPGPPGPPGEQGLPGLAGKEGTKGDPGPAGLPGKDGPPGLRGFPGDRGLPGPVGALGLKGNEGPPGPPGPAGSPGERGPAGAAGPIGIPGRPGPQGPPGPAGEKGAPGEKGPQGPAGRDGLQGPVGLPGPAGPVGPPGEDGDKGEIGEPGQKGSKGDKGEQGPPGPTGPQGPIGQPGPSGADGEPGPRGQQGLFGQKGDEGPRGFPGPPGPVGLQGLPGPPGEKGETGDVGQMGPPGPPGPRGPSGAPGADGPQGPPGGIGNPGAVGEKGEPGEAGEPGLPGEGGPPGPKGERGEKGESGPSGAAGPPGPKGPPGDDGPKGSPGPVGFPGDPGPPGEPGPAGQDGPPGDKGDDGEPGQTGSPGPTGEPGPSGPPGKRGPPGPAGPEGRQGEKGAKGEAGLEGPPGKTGPIGPQGAPGKPGPDGLRGIPGPVGEQGLPGSPGPDGPPGPMGPPGLPGLKGDSGPKGEKGHPGLIGLIGPPGEQGEKGDRGLPGPQGSSGPKGEQGITGPSGPIGPPGPPGLPGPPGPKGAKGSSGPTGPKGEAGHPGPPGPPGPPGEVIQPLPIQASRTRRNIDASQLLDDGNGENYVDYADGMEEIFGSLNSLKLEIEQMKRPLGTQQNPARTCKDLQLCHPDFPDGEYWVDPNQGCSRDSFKVYCNFTAGGSTCVFPDKKSEGARITSWPKENPGSWFSEFKRGKLLSYVDAEGNPVGVVQMTFLRLLSASAHQNVTYHCYQSVAWQDAATGSYDKALRFLGSNDEEMSYDNNPYIRALVDGCATKKGYQKTVLEIDTPKVEQVPIVDIMFNDFGEASQKFGFEVGPACFMG

SEQ ID NO: 73 - protein, 1499 aa, Homo sapiens
MMANWAEARPLLILIVLLGQFVSIKAQEEDEDEGYGEEIACTQNGQMYLNRDIWKPAPCQICVCDNGAILCDKIECQDVLDCADPVTPPGECCPVCSQTPGGGNTNFGRGRKGQKGEPGLVPVVTGIRGRPGPAGPPGSQGPRGERGPKGRPGPRGPQGIDGEPGVPGQPGAPGPPGHPSHPGPDGLSRPFSAQMAGLDEKSGLGSQVGLMPGSVGPVGPRGPQGLQGQQGGAGPTGPPGEPGDPGPMGPIGSRGPEGPPGKPGEDGEPGRNGNPGEVGFAGSPGARGFPGAPGLPGLKGHRGHKGLEGPKGEVGAPGSKGEAGPTGPMGAMGPLGPRGMPGERGRLGPQGAPGQRGAHGMPGKPGPMGPLGIPGSSGFPGNPGMKGEAGPTGARGPEGPQGQRGETGPPGPVGSPGLPGAIGTDGTPGAKGPTGSPGTSGPPGSAGPPGSPGPQGSTGPQGIRGQPGDPGVPGFKGEAGPKGEPGPHGIQGPIGPPGEEGKRGPRGDPGTVGPPGPVGERGAPGNRGFPGSDGLPGPKGAQGERGPVGSSGPKGSQGDPGRPGEPGLPGARGLTGNPGVQGPEGKLGPLGAPGEDGRPGPPGSIGIRGQPGSMGLPGPKGSSGDPGKPGEAGNAGVPGQRGAPGKDGEVGPSGPVGPPGLAGERGEQGPPGPTGFQGLPGPPGPPGEGGKPGDQGVPGDPGAVGPLGPRGERGNPGERGEPGITGLPGEKGMAGGHGPDGPKGSPGPSGTPGDTGPPGLQGMPGERGIAGTPGPKGDRGGIGEKGAEGTAGNDGARGLPGPLGPPGPAGPTGEKGEPGPRGLVGPPGSRGNPGSRGENGPTGAVGFAGPQGPDGQPGVKGEPGEPGQKGDAGSPGPQGLAGSPGPHGPNGVPGLKGGRGTQGPPGATGFPGSAGRVGPPGPAGAPGPAGPLGEPGKEGPPGLRGDPGSHGRVGDRGPAGPPGGPGDKGDPGEDGQPGPDGPPGPAGTTGQRGIVGMPGQRGERGMPGLPGPAGTPGKVGPTGATGDKGPPGPVGPPGSNGPVGEPGPEGPAGNDGTPGRDGAVGERGDRGDPGPAGLPGSQGAPGTPGPVGAPGDAGQRGDPGSRGPIGPPGRAGKRGLPGPQGPRGDKGDHGDRGDRGQKGHRGFTGLQGLPGPPGPNGEQGSAGIPGPFGPRGPPGPVGPSGKEGNPGPLGPIGPPGVRGSVGEAGPEGPPGEPGPPGPPGPPGHLTAALGDIMGHYDESMPDPLPEFTEDQAAPDDKNKTDPGVHATLKSLSSQIETMRSPDGSKKHPARTCDDLKLCHSAKQSGEYWIDPNQGSVEDAIKVYCNMETGETCISANPSSVPRKTWWASKSPDNKPVWYGLDMNRGSQFAYGDHQSPNTAITQMTFLRLLSKEASQNITYICKNSVGYMDDQAKNLKKAVVLKGANDLDIKAEGNIRFRYIVLQDTCSKRNGNVGKTVFEYRTQNVARLPIIDLAPVDVGGTDQEFGVEIGPVCFV

SEQ ID NO: 74 - protein, 1745 aa, Homo sapiens
MGNRRDLGQPRAGLCLLLAALQLLPGTQADPVDVLKALGVQGGQAGVPEGPGFCPQRTPEGDRAFRIGQASTLGIPTWELFPEGHFPENFSLLITLRGQPANQSVLLSIYDERGARQLGLALGPALGLLGDPFRPLPQQVNLTDGRWHRVAVSIDGEMVTLVADCEAQPPVLGHGPRFISIAGLTVLGTQDLGEKTFEGDIQELLISPDPQAAFQACERYLPDCDNLAPAATVAPQGEPETPRPRRKGKGKGRKKGRGRKGKGRKKNKEIWTSSPPPDSAENQTSTDIPKTETPAPNLPPTPTPLVVTSTVTTGLNATILERSLDPDSGTELGTLETKAAREDEEGDDSTMGPDFRAAEYPSRTQFQIFPGAGEKGAKGEPAVIEKGQQFEGPPGAPGPQGVVGPSGPPGPPGFPGDPGPPGPAGLPGIPGIDGIRGPPGTVIMMPFQFAGGSFKGPPVSFQQAQAQAVLQQTQLSMKGPPGPVGLTGRPGPVGLPGHPGLKGEEGAEGPQGPRGLQGPHGPPGRVGKMGRPGADGARGLPGDTGPKGDRGFDGLPGLPGEKGQRGDFGHVGQPGPPGEDGERGAEGPPGPTGQAGEPGPRGLLGPRGSPGPTGRPGVTGIDGAPGAKGNVGPPGEPGPPGQQGNHGSQGLPGPQGLIGTPGEKGPPGNPGIPGLPGSDGPLGHPGHEGPTGEKGAQGPPGSAGPPGYPGPRGVKGTSGNRGLQGEKGEKGEDGFPGFKGDVGLKGDQGKPGAPGPRGEDGPEGPKGQAGQAGEEGPPGSAGEKGKLGVPGLPGYPGRPGPKGSIGFPGPLGPIGEKGKSGKTGQPGLEGERGPPGSRGERGQPGATGQPGPKGDVGQDGAPGIPGEKGLPGLQGPPGFPGPKGPPGHQGKDGRPGHPGQRGELGFQGQTGPPGPAGVLGPQGKTGEVGPLGERGPPGPPGPPGEQGLPGLEGREGAKGELGPPGPLGKEGPAGLRGFPGPKGGPGDPGPTGLKGDKGPPGPVGANGSPGERGPLGPAGGIGLPGQSGSEGPVGPAGKKGSRGERGPPGPTGKDGIPGPLGPLGPPGAAGPSGEEGDKGDVGAPGHKGSKGDKGDAGPPGQPGIRGPAGHPGPPGADGAQGRRGPPGLFGQKGDDGVRGFVGVIGPPGLQGLPGPPGEKGEVGDVGSMGPHGAPGPRGPQGPTGSEGTPGLPGGVGQPGAVGEKGERGDAGDPGPPGAPGIPGPKGDIGEKGDSGPSGAAGPPGKKGPPGEDGAKGSVGPTGLPGDLGPPGDPGVSGIDGSPGEKGDPGDVGGPGPPGASGEPGAPGPPGKRGPSGHMGREGREGEKGAKGEPGPDGPPGRTGPMGARGPPGRVGPEGLRGIPGPVGEPGLLGAPGQMGPPGPLGPSGLPGLKGDTGPKGEKGHIGLIGLIGPPGEAGEKGDQGLPGVQGPPGPKGDPGPPGPIGSLGHPGPPGVAGPLGQKGSKGSPGSMGPRGDTGPAGPPGPPGAPAELHGLRRRRRFVPVPLPVVEGGLEEVLASLTSLSLELEQLRRPPGTAERPGLVCHELHRNHPHLPDGEYWIDPNQGCARDSFRVFCNFTAGGETCLYPDKKFEIVKLASWSKEKPGGWYSTFRRGKKFSYVDADGSPVNVVQLNFLKLLSATARQNFTYSCQNAAAWLDEATGDYSHSARFLGTNGEELSFNQTTAATVSVPQDGCRLRKGQTKTLFEFSSSRAGFLPLWDVAATDFGQTNQKFGFELGPVCFSS

SEQ ID NO: 75 - protein, 1028 aa, Homo sapiens
MRAARALLPLLLQACWTAAQDEPETPRAVAFQDCPVDLFFVLDTSESVALRLKPYGALVDKVKSFTKRFIDNLRDRYYRCDRNLVWNAGALHYSDEVEIIQGLTRMPGGRDALKSSVDAVKYFGKGTYTDCAIKKGLEQLLVGGSHLKENKYLIVVTDGHPLEGYKEPCGGLEDAVNEAKHLGVKVFSVAITPDHLEPRLSIIATDHTYRRNFTAADWGQSRDAEEAISQTIDTIVDMIKNNVEQVCCSFECQPARGPPGLRGDPGFEGERGKPGLPGEKGEAGDPGRPGDLGPVGYQGMKGEKGSRGEKGSRGPKGYKGEKGKRGIDGVDGVKGEMGYPGLPGCKGSPGFDGIQGPPGPKGDPGAFGLKGEKGEPGADGEAGRPGSSGPSGDEGQPGEPGPPGEKGEAGDEGNPGPDGAPGERGGPGERGPRGTPGTRGPRGDPGEAGPQGDQGREGPVGVPGDPGEAGPIGPKGYRGDEGPPGSEGARGAPGPAGPPGDPGLMGERGEDGPAGNGTEGFPGFPGYPGNRGAPGINGTKGYPGLKGDEGEAGDPGDDNNDIAPRGVKGAKGYRGPEGPQGPPGHQGPPGPDECEILDIIMKMCSCCECKCGPIDLLFVLDSSESIGLQNFEIAKDFVVKVIDRLSRDELVKFEPGQSYAGVVQYSHSQMQEHVSLRSPSIRNVQELKEAIKSLQWMAGGTFTGEALQYTRDQLLPPSPNNRIALVITDGRSDTQRDTTPLNVLCSPGIQVVSVGIKDVFDFIPGSDQLNVISCQGLAPSQGRPGLSLVKENYAELLEDAFLKNVTAQICIDKKCPDYTCPITFSSPADITILLDGSASVGSHNFDTTKRFAKRLAERFLTAGRTDPAHDVRVAVVQYSGTGQQRPERASLQFLQNYTALASAVDAMDFINDATDVNDALGYVTRFYREASSGAAKKRLLLFSDGNSQGATPAAIEKAVQEAQRAGIEIFVVVVGRQVNEPHIRVLVTGKTAEYDVAYGESHLFRVPSYQALLRGVFHQTVSRKVALG

SEQ ID NO: 76 - protein, 1019 aa, Homo sapiens
MLQGTCSVLLLWGILGAIQAQQQEVISPDTTERNNNCPEKTDCPIHVYFVLDTSESVTMQSPTDILLFHMKQFVPQFISQLQNEFYLDQVALSWRYGGLHFSDQVEVFSPPGSDRASFIKNLQGISSFRRGTFTDCALANMTEQIRQDRSKGTVHFAVVITDGHVTGSPCGGIKLQAERAREEGIRLFAVAPNQNLKEQGLRDIASTPHELYRNDYATMLPDSTEIDQDTINRIIKVMKHEAYGECYKVSCLEIPGPSGPKGYRGQKGAKGNMGEPGEPGQKGRQGDPGIEGPIGFPGPKGVPGFKGEKGEFGADGRKGAPGLAGKNGTDGQKGKLGRIGPPGCKGDPGNRGPDGYPGEAGSPGERGDQGGKGDPGRPGRRGPPGEIGAKGSKGYQGNSGAPGSPGVKGAKGGPGPRGPKGEPGRRGDPGTKGSPGSDGPKGEKGDPGPEGPRGLAGEVGNKGAKGDRGLPGPRGPQGALGEPGKQGSRGDPGDAGPRGDSGQPGPKGDPGRPGFSYPGPRGAPGEKGEPGPRGPEGGRGDFGLKGEPGRKGEKGEPADPGPPGEPGPRGPRGVPGPEGEPGPPGDPGLTECDVMTYVRETCGCCDCEKRCGALDVVFVIDSSESIGYTNFTLEKNFVINVVNRLGAIAKDPKSETGTRVGVVQYSHEGTFEAIQLDDERIDSLSSFKEAVKNLEWIAGGTWTPSALKFAYDRLIKESRRQKTRVFAVVITDGRHDPRDDDLNLRALCDRDVTVTAIGIGDMFHEKHESENLYSIACDKPQQVRNMTLFSDLVAEKFIDDMEDVLCPDPQIVCPDLPCQTELSVAQCTQRPVDIVFLLDGSERLGEQNFHKARRFVEQVARRLTLARRDDDPLNARVALLQFGGPGEQQVAFPLSHNLTAIHEALETTQYLNSFSHVGAGVVHAINAIVRSPRGGARRHAELSFVFLTDGVTGNDSLHESAHSMRKQNVVPTVLALGSDVDMDVLTTLSLGDRAAVFHEKDYDSLAQPGFFDRFIRWIC

SEQ ID NO: 77 - protein, 3177 aa, Homo sapiens
MRKHRHLPLVAVFCLFLSGFPTTHAQQQQADVKNGAAADIIFLVDSSWTIGEEHFQLVREFLYDVVKSLAVGENDFHFALVQFNGNPHTEFLLNTYRTKQEVLSHISNMSYIGGTNQTGKGLEYIMQSHLTKAAGSRAGDGVPQVIVVLTDGHSKDGLALPSAELKSADVNVFAIGVEDADEGALKEIASEPLNMHMFNLENFTSLHDIVGNLVSCVHSSVSPERAGDTETLKDITAQDSADIIFLIDGSNNTGSVNFAVILDFLVNLLEKLPIGTQQIRVGVVQFSDEPRTMFSLDTYSTKAQVLGAVKALGFAGGELANIGLALDFVVENHFTRAGGSRVEEGVPQVLVLISAGPSSDEIRYGVVALKQASVFSFGLGAQAASRAELQHIATDDNLVFTVPEFRSFGDLQEKLLPYIVGVAQRHIVLKPPTIVTQVIEVNKRDIVFLVDGSSALGLANFNAIRDFIAKVIQRLEIGQDLIQVAVAQYADTVRPEFYFNTHPTKREVITAVRKMKPLDGSALYTGSALDFVRNNLFTSSAGYRAAEGIPKLLVLITGGKSLDEISQPAQELKRSSIMAFAIGNKGADQAELEEIAFDSSLVFIPAEFRAAPLQGMLPGLLAPLRTLSGTPEVHSNKRDIIFLLDGSANVGKTNFPYVRDFVMNLVNSLDIGNDNIRVGLVQFSDTPVTEFSLNTYQTKSDILGHLRQLQLQGGSGLNTGSALSYVYANHFTEAGGSRIREHVPQLLLLLTAGQSEDSYLQAANALTRAGILTFCVGASQANKAELEQIAFNPSLVYLMDDFSSLPALPQQLIQPLTTYVSGGVEEVPLAQPESKRDILFLFDGSANLVGQFPVVRDFLYKIIDELNVKPEGTRIAVAQYSDDVKVESRFDEHQSKPEILNLVKRMKIKTGKALNLGYALDYAQRYIFVKSAGSRIEDGVLQFLVLLVAGRSSDRVDGPASNLKQSGVVPFIFQAKNADPAELEQIVLSPAFILAAESLPKIGDLHPQIVNLLKSVHNGAPAPVSGEKDVVFLLDGSEGVRSGFPLLKEFVQRVVESLDVGQDRVRVAVVQYSDRTRPEFYLNSYMNKQDVVNAVRQLTLLGGPTPNTGAALEFVLRNILVSSAGSRITEGVPQLLIVLTADRSGDDVRNPSVVVKRGGAVPIGIGIGNADITEMQTISFIPDFAVAIPTFRQLGTVQQVISERVTQLTREELSRLQPVLQPLPSPGVGGKRDVVFLIDGSQSAGPEFQYVRTLIERLVDYLDVGFDTTRVAVIQFSDDPKVEFLLNAHSSKDEVQNAVQRLRPKGGRQINVGNALEYVSRNIFKRPLGSRIEEGVPQFLVLISSGKSDDEVDDPAVELKQFGVAPFTIARNADQEELVKISLSPEYVFSVSTFRELPSLEQKLLTPITTLTSEQIQKLLASTRYPPPAVESDAADIVFLIDSSEGVRPDGFAHIRDFVSRIVRRLNIGPSKVRVGVVQFSNDVFPEFYLKTYRSQAPVLDAIRRLRLRGGSPLNTGKALEFVARNLFVKSAGSRIEDGVPQHLVLVLGGKSQDDVSRFAQVIRSSGIVSLGVGDRNIDRTELQTITNDPRLVFTVREFRELPNIEERIMNSFGPSAATPAPPGVDTPPPSRPEKKKADIVFLLDGSINFRRDSFQEVLRFVSEIVDTVYEDGDSIQVGLVQYNSDPTDEFFLKDFSTKRQIIDAINKVVYKGGRHANTKVGLEHLRVNHFVPEAGSRLDQRVPQIAFVITGGKSVEDAQDVSLALTQRGVKVFAVGVRNIDSEEVGKIASNSATAFRVGNVQELSELSEQVLETLHDAMHETLCPGVTDAAKACNLDVILGFDGSRDQNVFVAQKGFESKVDAILNRISQMHRVSCSGGRSPTVRVSVVANTPSGPVEAFDFDEYQPEMLEKFRNMRSQHPYVLTEDTLKVYLNKFRQSSPDSVKVVIHFTDGADGDLADLHRASENLRQEGVRALILVGLERVVNLERLMHLEFGRGFMYDRPLRLNLLDLDYELAEQLDNIAEKACCGVPCKCSGQRGDRGPIGSIGPKGIPGEDGYRGYPGDEGGPGERGPPGVNGTQGFQGCPGQRGVKGSRGFPGEKGEVGEIGLDGLDGEDGDKGLPGSSGEKGNPGRRGDKGPRGEKGERGDVGIRGDPGNPGQDSQERGPKGETGDLGPMGVPGRDGVPGGPGETGKNGGFGRRGPPGAKGNKGGPGQPGFEGEQGTRGAQGPAGPAGPPGLIGEQGISGPRGSGGAAGAPGERGRTGPLGRKGEPGEPGPKGGIGNRGPRGETGDDGRDGVGSEGRRGKKGERGFPGYPGPKGNPGEPGLNGTTGPKGIRGRRGNSGPPGIVGQKGDPGYPGPAGPKGNRGDSIDQCALIQSIKDKCPCCYGPLECPVFPTELAFALDTSEGVNQDTFGRMRDVVLSIVNDLTIAESNCPRGARVAVVTYNNEVTTEIRFADSKRKSVLLDKIKNLQVALTSKQQSLETAMSFVARNTFKRVRNGFLMRKVAVFFSNTPTRASPQLREAVLKLSDAGITPLFLTRQEDRQLINALQINNTAVGHALVLPAGRDLTDFLENVLTCHVCLDICNIDPSCGFGSWRPSFRDRRAAGSDVDIDMAFILDSAETTTLFQFNEMKKYIAYLVRQLDMSPDPKASQHFARVAVVQHAPSESVDNASMPPVKVEFSLTDYGSKEKLVDFLSRGMTQLQGTRALGSAIEYTIENVFESAPNPRDLKIVVLMLTGEVPEQQLEEAQRVILQAKCKGYFFVVLGIGRKVNIKEVYTFASEPNDVFFKLVDKSTELNEEPLMRFGRLLPSFVSSENAFYLSPDIRKQCDWFQGDQPTKNLVKFGHKQVNVPNNVTSSPTSNPVTTTKPVTTTKPVTTTTKPVTTTTKPVTIINQPSVKPAAAKPAPAKPVAAKPVATKMATVRPPVAVKPATAAKPVAAKPAAVRPPAAAAAKPVATKPEVPRPQAAKPAATKPATTKPMVKMSREVQVFEITENSAKLHWERAEPPGPYFYDLTVTSAHDQSLVLKQNLTVTDRVIGGLLAGQTYHVAVVCYLRSQVRATYHGSFSTKKSQPPPPQPARSASSSTINLMVSTEPLALTETDICKLPKDEGTCRDFILKWYYDPNTKSCARFWYGGCGGNENKFGSQKECEKVCAPVLAKPGVISVMGT

SEQ ID NO: 78 - protein, 2944 aa, Homo sapiens
MTLRLLVAALCAGILAEAPRVRAQHRERVTCTRLYAADIVFLLDGSSSIGRSNFREVRSFLEGLVLPFSGAASAQGVRFATVQYSDDPRTEFGLDALGSGGDVIRAIRELSYKGGNTRTGAAILHVADHVFLPQLARPGVPKVCILITDGKSQDLVDTAAQRLKGQGVKLFAVGIKNADPEELKRVASQPTSDFFFFVNDFSILRTLLPLVSRRVCTTAGGVPVTRPPDDSTSAPRDLVLSEPSSQSLRVQWTAASGPVTGYKVQYTPLTGLGQPLPSERQEVNVPAGETSVRLRGLRPLTEYQVTVIALYANSIGEAVSGTARTTALEGPELTIQNTTAHSLLVAWRSVPGATGYRVTWRVLSGGPTQQQELGPGQGSVLLRDLEPGTDYEVTVSTLFGRSVGPATSLMARTDASVEQTLRPVILGPTSILLSWNLVPEARGYRLEWRRETGLEPPQKVVLPSDVTRYQLDGLQPGTEYRLTLYTLLEGHEVATPATVVPTGPELPVSPVTDLQATELPGQRVRVSWSPVPGATQYRIIVRSTQGVERTLVLPGSQTAFDLDDVQAGLSYTVRVSARVGPREGSASVLTVRREPETPLAVPGLRVVVSDATRVRVAWGPVPGASGFRISWSTGSGPESSQTLPPDSTATDITGLQPGTTYQVAVSVLRGREEGPAAVIVARTDPLGPVRTVHVTQASSSSVTITWTRVPGATGYRVSWHSAHGPEKSQLVSGEATVAELDGLEPDTEYTVHVRAHVAGVDGPPASVVVRTAPEPVGRVSRLQILNASSDVLRITWVGVTGATAYRLAWGRSEGGPMRHQILPGNTDSAEIRGLEGGVSYSVRVTALVGDREGTPVSIVVTTPPEAPPALGTLHVVQRGEHSLRLRWEPVPRAQGFLLHWQPEGGQEQSRVLGPELSSYHLDGLEPATQYRVRLSVLGPAGEGPSAEVTARTESPRVPSIELRVVDTSIDSVTLAWTPVSRASSYILSWRPLRGPGQEVPGSPQTLPGISSSQRVTGLEPGVSYIFSLTPVLDGVRGPEASVTQTPVCPRGLADVVFLPHATQDNAHRAEATRRVLERLVLALGPLGPQAVQVGLLSYSHRPSPLFPLNGSHDLGIILQRIRDMPYMDPSGNNLGTAVVTAHRYMLAPDAPGRRQHVPGVMVLLVDEPLRGDIFSPIREAQASGLNVVMLGMAGADPEQLRRLAPGMDSVQTFFAVDDGPSLDQAVSGLATALCQASFTTQPRPEPCPVYCPKGQKGEPGEMGLRGQVGPPGDPGLPGRTGAPGPQGPPGSATAKGERGFPGADGRPGSPGRAGNPGTPGAPGLKGSPGLPGPRGDPGERGPRGPKGEPGAPGQVIGGEGPGLPGRKGDPGPSGPPGPRGPLGDPGPRGPPGLPGTAMKGDKGDRGERGPPGPGEGGIAPGEPGLPGLPGSPGPQGPVGPPGKKGEKGDSEDGAPGLPGQPGSPGEQGPRGPPGAIGPKGDRGFPGPLGEAGEKGERGPPGPAGSRGLPGVAGRPGAKGPEGPPGPTGRQGEKGEPGRPGDPAVVGPAVAGPKGEKGDVGPAGPRGATGVQGERGPPGLVLPGDPGPKGDPGDRGPIGLTGRAGPPGDSGPPGEKGDPGRPGPPGPVGPRGRDGEVGEKGDEGPPGDPGLPGKAGERGLRGAPGVRGPVGEKGDQGDPGEDGRNGSPGSSGPKGDRGEPGPPGPPGRLVDTGPGAREKGEPGDRGQEGPRGPKGDPGLPGAPGERGIEGFRGPPGPQGDPGVRGPAGEKGDRGPPGLDGRSGLDGKPGAAGPSGPNGAAGKAGDPGRDGLPGLRGEQGLPGPSGPPGLPGKPGEDGKPGLNGKNGEPGDPGEDGRKGEKGDSGASGREGRDGPKGERGAPGILGPQGPPGLPGPVGPPGQGFPGVPGGTGPKGDRGETGSKGEQGLPGERGLRGEPGSVPNVDRLLETAGIKASALREIVETWDESSGSFLPVPERRRGPKGDSGEQGPPGKEGPIGFPGERGLKGDRGDPGPQGPPGLALGERGPPGPSGLAGEPGKPGIPGLPGRAGGVGEAGRPGERGERGEKGERGEQGRDGPPGLPGTPGPPGPPGPKVSVDEPGPGLSGEQGPPGLKGAKGEPGSNGDQGPKGDRGVPGIKGDRGEPGPRGQDGNPGLPGERGMAGPEGKPGLQGPRGPPGPVGGHGDPGPPGAPGLAGPAGPQGPSGLKGEPGETGPPGRGLTGPTGAVGLPGPPGPSGLVGPQGSPGLPGQVGETGKPGAPGRDGASGKDGDRGSPGVPGSPGLPGPVGPKGEPGPTGAPGQAVVGLPGAKGEKGAPGGLAGDLVGEPGAKGDRGLPGPRGEKGEAGRAGEPGDPGEDGQKGAPGPKGFKGDPGVGVPGSPGPPGPPGVKGDLGLPGLPGAPGVVGFPGQTGPRGEMGQPGPSGERGLAGPPGREGIPGPLGPPGPPGSVGPPGASGLKGDKGDPGVGLPGPRGERGEPGIRGEDGRPGQEGPRGLTGPPGSRGERGEKGDVGSAGLKGDKGDSAVILGPPGPRGAKGDMGERGPRGLDGDKGPRGDNGDPGDKGSKGEPGDKGSAGLPGLRGLLGPQGQPGAAGIPGDPGSPGKDGVPGIRGEKGDVGFMGPRGLKGERGVKGACGLDGEKGDKGEAGPPGRPGLAGHKGEMGEPGVPGQSGAPGKEGLIGPKGDRGFDGQPGPKGDQGEKGERGTPGIGGFPGPSGNDGSAGPPGPPGSVGPRGPEGLQGQKGERGPPGERVVGAPGVPGAPGERGEQGRPGPAGPRGEKGEAALTEDDIRGFVRQEMSQHCACQGQFIASGSRPLPSYAADTAGSQLHAVPVLRVSHAEEEERVPPEDDEYSEYSEYSVEEYQDPEAPWDSDDPCSLPLDEGSCTAYTLRWYHRAVTGSTEACHPFVYGGCGGNANRFGTREACERRCPPRVVQSQGTGTAQD

SEQ ID NO: 79 - protein, 724 aa, Homo sapiens
MAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGVGTPAAAAAKAAAKAAQFGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGAAGLGGVLGGAGQFPLGGVAARPGFGLSPIFPGGACLGKACGRKRK

SEQ ID NO: 80 - protein, 677 aa, Homo sapiens
MAGLTAAAPRPGVLLLLLSILHPSRPGGVPGAIPGGVPGGVFYPALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGVAARPGFGLSPIFPGGACLGKACGRKRK

SEQ ID NO: 81 - protein, 692 aa, Homo sapiens
MAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAAPSVPGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGVAARPGFGLSPIFPGGACLGKACGRKRK

SEQ ID NO: 82 - protein, 711 aa, Homo sapiens
MAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAAPSVPGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGVGTPAAAAAKAAAKAAQFGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGVAARPGFGLSPIFPGGACLGKACGRKRK

SEQ ID NO: 83 - protein, 705 aa, Homo sapiens
MAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGAAGLGGVLGGAGQFPLGGVAARPGFGLSPIFPGGACLGKACGRKRK

SEQ ID NO: 84 - protein, 706 aa, Homo sapiens
MAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGVGTPAAAAAKAAAKAAQFGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGVAARPGFGLSPIFPGGACLGKACGRKRK

SEQ ID NO: 85 - protein, 643 aa, Homo sapiens
MAGLTAAAPRPGVLLLLLSILHPSRPGGVPGAIPGGVPGGVFYPGAGLGALGGGALGPGGKPLKPGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGPFGGPQPGVPLGYPIKAPKLPGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGAEAQAAAAAKAAKYGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGAAGLGGVLGGAGQFPLGGVAARPGFGLSPIFPGGACLGKACGRKRK

SEQ ID NO: 86 - protein, 700 aa, Homo sapiens
MAGLTAAAPRPGVLLLLLSILHPSRPGGVPGAIPGGVPGGVFYPALGPGGKPLKPVPGGLAGAGLGAGLGAFPAVTFPGALVPGGVADAAAAYKAAKAGAGLGGVPGVGGLGVSAAPSVPGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGAAGLGGVLGGAGQFPLGGVAARPGFGLSPIFPGGACLGKACGRKRK

SEQ ID NO: 87 - protein, 730 aa, Homo sapiens
MAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGVGTPAAAAAKAAAKAAQFALLNLAGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGAAGLGGVLGGAGQFPLGGVAARPGFGLSPIFPGGACLGKACGRKRK

SEQ ID NO: 88 - protein, 658 aa, Homo sapiens
MAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGGAFAGIPGVGPFGGPQPGVPLGYPIKAPKLPGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGLVPGVGVAPGVGVAPGVGVAPGVGLAPGVGVAPGVGVAPGVGVAPGIGPGGVAGAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGVAARPGFGLSPIFPGGACLGKACGRKRK

SEQ ID NO: 89 - protein, 714 aa, Homo sapiens
MAGLTAAAPRPGVLLLLLSILHPSRPGGVPGAIPGGVPGGVFYPALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGVGTPAAAAAKAAAKAAQFGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGAAGLGGVLGGAGQFPLGGVAARPGFGLSPIFPGGACLGKACGRKRK

SEQ ID NO: 90 - protein, 617 aa, Homo sapiens
MAGLTAAAPRPGVLLLLLSILHPSRPGGVPGAIPGGVPGGVFYPALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGAEAQAAAAAKAAKYGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGVAARPGFGLSPIFPGGACLGKACGRKRK

SEQ ID NO: 91 - protein, 786 aa, Homo sapiens
MAGLTAAAPRPGVLLLLLSILHPSRPGGVPGAIPGGVPGGVFYPGAGLGALGGGALGPGGKPLKPVPGGLAGAGLGAGLGAFPAVTFPGALVPGGVADAAAAYKAAKAGAGLGGVPGVGGLGVSAGAVVPQPGAGVKPGKVPGVGLPGVYPGGVLPGARFPGVGVLPGVPTGAGVKPKAPGVGGAFAGIPGVGPFGGPQPGVPLGYPIKAPKLPGGYGLPYTTGKLPYGYGPGGVAGAAGKAGYPTGTGVGPQAAAAAAAKAAAKFGAGAAGVLPGVGGAGVPGVPGAIPGIGGIAGVGTPAAAAAAAAAAKAAKYGAAAGLVPGGPGFGPGVVGVPGAGVPGVGVPGAGIPVVPGAGIPGAAVPGVVSPEAAAKAAAKAAKYGARPGVGVGGIPTYGVGAGGFPGFGVGVGGIPGVAGVPGVGGVPGVGGVPGVGISPEAQAAAAAKAAKYGAAGAGVLGGLVPGAPGAVPGVPGTGGVPGVGTPAAAAAKAAAKAAQFGLVPGVGVAPGVGVAPGVGVAPGVGLAPGVGVAPGVGVAPGVGVAPGIGPGGVAAAAKSAAKVAAKAQLRAAAGLGAGIPGLGVGVGVPGLGVGAGVPGLGVGAGVPGFGAGADEGVRRSLSPELREGDPSSSQHLPSTPSSPRVPGALAAAKAAKYGAAVPGVLGGLGALGGVGIPGGVVGAGPAAAAAAAKAAAKAAQFGLVGAAGLGGLGVGGLGVPGVGGLGGIPPAAAAKAAKYGAAGLGGVLGGAGQFPLGGVAARPGFGLSPIFPGGACLGKACGRKRK

SEQ ID NO: 92 - protein, 417 aa, Homo sapiens
MRFAWTVLLLGPLQLCALVHCAPPAAGQQQPPREPPAAPGAWRQQIQWENNGQVFSLLSLGSQYQPQRRRDPGAAVPGAANASAQQPRTPILLIRDNRTAAARTRTAGSSGVTAGRPRPTARHWFQAGYSTSRAREAGASRAENQTAPGEVPALSNLRPPSRVDGMVGDDPYNPYKYSDDNPYYNYYDTYERPRPGGRYRPGYGTGYFQYGLPDLVADPYYIQASTYVQKMSMYNLRCAAEENCLASTAYRADVRDYDHRVLLRFPQRVKNQGTSDFLPSRPRYSWEWHSCHQHYHSMDEFSHYDLLDANTQRRVAEGHKASFCLEDTSCDYGYHRRFACTAHTQGLSPGCYDTYGADIDCQWIDITDVKPGNYILKVSVNPSYLVPESDYTNNVVRCDIRYTGHHAYASGCTISPY

SEQ ID NO: 93 - protein, 187 aa, Homo sapiens
MSMYNLRCAAEENCLASTAYRADVRDYDHRVLLRFPQRVKNQGTSDFLPSRPRYSWEWHSCHQHYHSMDEFSHYDLLDANTQRRVAEGHKASFCLEDTSCDYGYHRRFACTAHTQGLSPGCYDTYGADIDCQWIDITDVKPGNYILKVSVNPSYLVPESDYTNNVVRCDIRYTGHHAYASGCTISPY

SEQ ID NO: 94 - protein, 1132 aa, Homo sapiens
MPRAPRCRAVRSLLRSHYREVLPLATFVRRLGPQGWRLVQRGDPAAFRALVAQCLVCVPWDARPPPAAPSFRQVSCLKELVARVLQRLCERGAKNVLAFGFALLDGARGGPPEAFTTSVRSYLPNTVTDALRGSGAWGLLLRRVGDDVLVHLLARCALFVLVAPSCAYQVCGPPLYQLGAATQARPPPHASGPRRRLGCERAWNHSVREAGVPLGLPAPGARRRGGSASRSLPLPKRPRRGAAPEPERTPVGQGSWAHPGRTRGPSDRGFCVVSPARPAEEATSLEGALSGTRHSHPSVGRQHHAGPPSTSRPPRPWDTPCPPVYAETKHFLYSSGDKEQLRPSFLLSSLRPSLTGARRLVETIFLGSRPWMPGTPRRLPRLPQRYWQMRPLFLELLGNHAQCPYGVLLKTHCPLRAAVTPAAGVCAREKPQGSVAAPEEEDTDPRRLVQLLRQHSSPWQVYGFVRACLRRLVPPGLWGSRHNERRFLRNTKKFISLGKHAKLSLQELTWKMSVRDCAWLRRSPGVGCVPAAEHRLREEILAKFLHWLMSVYVVELLRSFFYVTETTFQKNRLFFYRKSVWSKLQSIGIRQHLKRVQLRELSEAEVRQHREARPALLTSRLRFIPKPDGLRPIVNMDYVVGARTFRREKRAERLTSRVKALFSVLNYERARRPGLLGASVLGLDDIHRAWRTFVLRVRAQDPPPELYFVKVDVTGAYDTIPQDRLTEVIASIIKPQNTYCVRRYAVVQKAAHGHVRKAFKSHVSTLTDLQPYMRQFVAHLQETSPLRDAVVIEQSSSLNEASSGLFDVFLRFMCHHAVRIRGKSYVQCQGIPQGSILSTLLCSLCYGDMENKLFAGIRRDGLLLRLVDDFLLVTPHLTHAKTFLRTLVRGVPEYGCVVNLRKTVVNFPVEDEALGGTAFVQMPAHGLFPWCGLLLDTRTLEVQSDYSSYARTSIRASLTFNRGFKAGRNMRRKLFGVLRLKCHSLFLDLQVNSLQTVCTNIYKILLLQAYRFHACVLQLPFHQQVWKNPTFFLRVISDTASLCYSILKAKNAGMSLGAKGAAGPLPSEAVQWLCHQAFLLKLTRHRVTYVPLLGSLRTAQTQLSRKLPGTTLTALEAAANPALPSDFKTILD

SEQ ID NO: 95 - protein, 1069 aa, Homo sapiens
MPRAPRCRAVRSLLRSHYREVLPLATFVRRLGPQGWRLVQRGDPAAFRALVAQCLVCVPWDARPPPAAPSFRQVSCLKELVARVLQRLCERGAKNVLAFGFALLDGARGGPPEAFTTSVRSYLPNTVTDALRGSGAWGLLLRRVGDDVLVHLLARCALFVLVAPSCAYQVCGPPLYQLGAATQARPPPHASGPRRRLGCERAWNHSVREAGVPLGLPAPGARRRGGSASRSLPLPKRPRRGAAPEPERTPVGQGSWAHPGRTRGPSDRGFCVVSPARPAEEATSLEGALSGTRHSHPSVGRQHHAGPPSTSRPPRPWDTPCPPVYAETKHFLYSSGDKEQLRPSFLLSSLRPSLTGARRLVETIFLGSRPWMPGTPRRLPRLPQRYWQMRPLFLELLGNHAQCPYGVLLKTHCPLRAAVTPAAGVCAREKPQGSVAAPEEEDTDPRRLVQLLRQHSSPWQVYGFVRACLRRLVPPGLWGSRHNERRFLRNTKKFISLGKHAKLSLQELTWKMSVRDCAWLRRSPGVGCVPAAEHRLREEILAKFLHWLMSVYVVELLRSFFYVTETTFQKNRLFFYRKSVWSKLQSIGIRQHLKRVQLRELSEAEVRQHREARPALLTSRLRFIPKPDGLRPIVNMDYVVGARTFRREKRAERLTSRVKALFSVLNYERARRPGLLGASVLGLDDIHRAWRTFVLRVRAQDPPPELYFVKVDVTGAYDTIPQDRLTEVIASIIKPQNTYCVRRYAVVQKAAHGHVRKAFKSHVSTLTDLQPYMRQFVAHLQETSPLRDAVVIEQSSSLNEASSGLFDVFLRFMCHHAVRIRGKSYVQCQGIPQGSILSTLLCSLCYGDMENKLFAGIRRDGLLLRLVDDFLLVTPHLTHAKTFLSYARTSIRASLTFNRGFKAGRNMRRKLFGVLRLKCHSLFLDLQVNSLQTVCTNIYKILLLQAYRFHACVLQLPFHQQVWKNPTFFLRVISDTASLCYSILKAKNAGMSLGAKGAAGPLPSEAVQWLCHQAFLLKLTRHRVTYVPLLGSLRTAQTQLSRKLPGTTLTALEAAANPALPSDFKTILD

SEQ ID NO: 96 - protein, 2477 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDPTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPEVPQLTDLSFVDITDSSIGLRWTPLNSSTIIGYRITVVAAGEGIPIFEDFVDSSVGYYTVTGLEPGIDYDISVITLINGGESAPTTLTQQTAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTDELPQLVTLPHPNLHGPEILDVPSTVQKTPFVTHPGYDTGNGIQLPGTSGQQPSVGQQMIFEEHGFRRTTPPTTATPIRHRPRPYPPNVGEEIQIGHIPREDVDYHLYPHGPGLNPNASTGQEALSQTTISWAPFQDTSEYIISCHPVGTDEEPLQFRVPGTSTSATLTGLTRGATYNIIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 97 - protein, 2355 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDPTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTDELPQLVTLPHPNLHGPEILDVPSTVQKTPFVTHPGYDTGNGIQLPGTSGQQPSVGQQMIFEEHGFRRTTPPTTATPIRHRPRPYPPNVGQEALSQTTISWAPFQDTSEYIISCHPVGTDEEPLQFRVPGTSTSATLTGLTRGATYNIIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 98 - protein, 2330 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDPTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTVQKTPFVTHPGYDTGNGIQLPGTSGQQPSVGQQMIFEEHGFRRTTPPTTATPIRHRPRPYPPNVGQEALSQTTISWAPFQDTSEYIISCHPVGTDEEPLQFRVPGTSTSATLTGLTRGATYNIIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 99 - protein, 2296 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDPTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTTIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTDELPQLVTLPHPNLHGPEILDVPSTVQKTPFVTHPGYDTGNGIQLPGTSGQQPSVGQQMIFEEHGFRRTTPPTTATPIRHRPRPYPPNVGEEIQIGHIPREDVDYHLYPHGPGLNPNASTGQEALSQTTISWAPFQDTSEYIISCHPVGTDEEPLQFRVPGTSTSATLTGLTRGATYNIIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 100 - protein, 2176 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDPTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTTIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTGQEALSQTTISWAPFQDTSEYIISCHPVGTDEEPLQFRVPGTSTSATLTGLTRGATYNIIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 101 - protein, 657 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPVSIPPRNLGY

SEQ ID NO: 102 - protein, 478 aa, Homo sapiens
MAPLRPLLILALLAWVALADQESCKGRCTEGFNVDKKCQCDELCSYYQSCCTDYTAECKPQVTRGDVFTMPEDEYTVYDDGEEKNNATVHEQVGGPSLTSDLQAQSKGNPEQTPVLKPEEEAPAPEVGASKPEGIDSRPETLHPGRPQPPAEEELCSGKPFDAFTDLKNGSLFAFRGQYCYELDEKAVRPGYPKLIRDVWGIEGPIDAAFTRINCQGKTYLFKGSQYWRFEDGVLDPDYPRNISDGFDGIPDNVDAALALPAHSYSGRERVYFFKGKQYWEYQFQHQPSQEECEGSSLSAVFEHFAMMQRDSWEDIFELLFWGRTSAGTRQPQFISRDWHGVPGQVDAAMAGRIYISGMAPRPSLAKKQRFRHRNRKGYRSQRGHSRGRNQNSRRPSRATWLSLFSSEESNLGANNYDDYRMDWLVPATCEPIQSVFFFSGDKYYRVNLRTRRVDTVDPPYPRSIAQYWLGCPAPGHL

SEQ ID NO: 103 - protein, 1247 aa, Homo sapiens
MLASSSRIRAAWTRALLLPLLLAGPVGCLSRQELFPFGPGQGDLELEDGDDFVSPALELSGALRFYDRSDIDAVYVTTNGIIATSEPPAKESHPGLFPPTFGAVAPFLADLDTTDGLGKVYYREDLSPSITQRAAECVHRGFPEISFQPSSAVVVTWESVAPYQGPSRDPDQKGKRNTFQAVLASSDSSSYAIFLYPEDGLQFHTTFSKKENNQVPAVVAFSQGSVGFLWKSNGAYNIFANDRESVENLAKSSNSGQQGVWVFEIGSPATTNGVVPADVILGTEDGAEYDDEDEDYDLATTRLGLEDVGTTPFSYKALRRGGADTYSVPSVLSPRRAATERPLGPPTERTRSFQLAVETFHQQHPQVIDVDEVEETGVVFSYNTDSRQTCANNRHQCSVHAECRDYATGFCCSCVAGYTGNGRQCVAEGSPQRVNGKVKGRIFVGSSQVPIVFENTDLHSYVVMNHGRSYTAISTIPETVGYSLLPLAPVGGIIGWMFAVEQDGFKNGFSITGGEFTRQAEVTFVGHPGNLVIKQRFSGIDEHGHLTIDTELEGRVPQIPFGSSVHIEPYTELYHYSTSVITSSSTREYTVTEPERDGASPSRIYTYQWRQTITFQECVHDDSRPALPSTQQLSVDSVFVLYNQEEKILRYALSNSIGPVREGSPDALQNPCYIGTHGCDTNAACRPGPRTQFTCECSIGFRGDGRTCYDIDECSEQPSVCGSHTICNNHPGTFRCECVEGYQFSDEGTCVAVVDQRPINYCETGLHNCDIPQRAQCIYTGGSSYTCSCLPGFSGDGQACQDVDECQPSRCHPDAFCYNTPGSFTCQCKPGYQGDGFRCVPGEVEKTRCQHEREHILGAAGATDPQRPIPPGLFVPECDAHGHYAPTQCHGSTGYCWCVDRDGREVEGTRTRPGMTPPCLSTVAPPIHQGPAVPTAVIPLPPGTHLLFAQTGKIERLPLEGNTMRKTEAKAFLHVPAKVIIGLAFDCVDKMVYWTDITEPSIGRASLHGGEPTTIIRQDLGSPEGIAVDHLGRNIFWTDSNLDRIEVAKLDGTQRRVLFETDLVNPRGIVTDSVRGNLYWTDWNRDNPKIETSYMDGTNRRILVQDDLGLPNGLTFDAFSSQLCWVDAGTNRAECLNPSQPSRRKALEGLQYPFAVTSYGKNLYFTDWKMNSVVALDLAISKETDAFQPHKQTRLYGITTALSQCPQGHNYCSVNNGGCTHLCLATPGSRTCRCPDNTLGVDCIEQK

SEQ ID NO: 104 - protein, 3075 aa, Homo sapiens
MRGGVLLVLLLCVAAQCRQRGLFPAILNLASNAHISTNATCGEKGPEMFCKLVEHVPGRPVRNPQCRICDGNSANPRERHPISHAIDGTNNWWQSPSIQNGREYHWVTITLDLRQVFQVAYVIIKAANAPRPGNWILERSLDGTTFSPWQYYAVSDSECLSRYNITPRRGPPTYRADDEVICTSYYSRLVPLEHGEIHTSLINGRPSADDLSPKLLEFTSARYIRLRLQRIRTLNADLMTLSHREPKELDPIVTRRYYYSIKDISVGGMCICYGHASSCPWDETTKKLQCQCEHNTCGESCNRCCPGYHQQPWRPGTVSSGNTCEACNCHNKAKDCYYDESVAKQKKSLNTAGQFRGGGVCINCLQNTMGINCETCIDGYYRPHKVSPYEDEPCRPCNCDPVGSLSSVCIKDDLHSDLHNGKQPGQCPCKEGYTGEKCDRCQLGYKDYPTCVSCGCNPVGSASDEPCTGPCVCKENVEGKACDRCKPGFYNLKEKNPRGCSECFCFGVSDVCSSLSWPVGQVNSMSGWLVTDLISPRKIPSQQDALGGRHQVSINNTAVMQRLAPKYYWAAPEAYLGNKLTAFGGFLKYTVSYDIPVETVDSNLMSHADVIIKGNGLTLSTQAEGLSLQPYEEYLNVVRLVPENFQDFHSKRQIDRDQLMTVLANVTHLLIRANYNSAKMALYRLESVSLDIASSNAIDLVVAADVEHCECPQGYTGTSCESCLSGYYRVDGILFGGICQPCECHGHAAECNVHGVCIACAHNTTGVHCEQCLPGFYGEPSRGTPGDCQPCACPLTIASNNFSPTCHLNDGDEVVCDWCAPGYSGAWCERCADGYYGNPTVPGESCVPCDCSGNVDPSEAGHCDSVTGECLKCLGNTDGAHCERCADGFYGDAVTAKNCRACECHVKGSHSAVCHLETGLCDCKPNVTGQQCDQCLHGYYGLDSGHGCRPCNCSVAGSVSDGCTDEGQCHCVPGVAGKRCDRCAHGFYAYQDGSCTPCDCPHTQNTCDPETGECVCPPHTQGVKCEECEDGHWGYDAEVGCQACNCSLVGSTHHRCDVVTGHCQCKSKFGGRACDQCSLGYRDFPDCVPCDCDLRGTSGDACNLEQGLCGCVEETGACPCKENVFGPQCNECREGTFALRADNPLGCSPCFCSGLSHLCSELEDYVRTPVTLGSDQPLLRVVSQSNLRGTTEGVYYQAPDFLLDAATVRQHIRAEPFYWRLPQQFQGDQLMAYGGKLKYSVAFYSLDGVGTSNFEPQVLIKGGRIRKQVIYMDAPAPENGVRQEQEVAMRENFWKYFNSVSEKPVTREDFMSVLSDIEYILIKASYGQGLQQSRISDISMEVGRKAEKLHPEEEVASLLENCVCPPGTVGFSCQDCAPGYHRGKLPAGSDRGPRPLVAPCVPCSCNNHSDTCDPNTGKCLNCGDNTAGDHCDVCTSGYYGKVTGSASDCALCACPHSPPASFSPTCVLEGDHDFRCDACLLGYEGKHCERCSSSYYGNPQTPGGSCQKCDCNPHGSVHGDCDRTSGQCVCRLGASGLRCDECEPRHILMETDCVSCDDECVGVLLNDLDEIGDAVLSLNLTGIIPVPYGILSNLENTTKYLQESLLKENMQKDLGKIKLEGVAEETDNLQKKLTRMLASTQKVNRATERIFKESQDLAIAIERLQMSITEIMEKTTLNQTLDEDFLLPNSTLQNMQQNGTSLLEIMQIRDFTQLHQNATLELKAAEDLLSQIQENYQKPLEELEVLKEAASHVLSKHNNELKAAEALVREAEAKMQESNHLLLMVNANLREFSDKKLHVQEEQNLTSELIVQGRGLIDAAAAQTDAVQDALEHLEDHQDKLLLWSAKIRHHIDDLVMHMSQRNAVDLVYRAEDHAAEFQRLADVLYSGLENIRNVSLNATSAAYVHYNIQSLIEESEELARDAHRTVTETSLLSESLVSNGKAAVQRSSRFLKEGNNLSRKLPGIALELSELRNKTNRFQENAVEITRQTNESLLILRAIPKGIRDKGAKTKELATSASQSAVSTLRDVAGLSQELLNTSASLSRVNTTLRETHQLLQDSTMATLLAGRKVKDVEIQANLLFDRLKPLKMLEENLSRNLSEIKLLISQARKQAASIKVAVSADRDCIRAYQPQISSTNYNTLTLNVKTQEPDNLLFYLGSSTASDFLAVEMRRGRVAFLWDLGSGSTRLEFPDFPIDDNRWHSIHVARFGNIGSLSVKEMSSNQKSPTKTSKSPGTANVLDVNNSTLMFVGGLGGQIKKSPAVKVTHFKGCLGEAFLNGKSIGLWNYIEREGKCRGCFGSSQNEDPSFHFDGSGYSVVEKSLPATVTQIIMLFNTFSPNGLLLYLGSYGTKDFLSIELFRGRVKVMTDLGSGPITLLTDRRYNNGTWYKIAFQRNRKQGVLAVIDAYNTSNKETKQGETPGASSDLNRLDKDPIYVGGLPRSRVVRRGVTTKSFVGCIKNLEISRSTFDLLRNSYGVRKGCLLEPIRSVSFLKGGYIELPPKSLSPESEWLVTFATTNSSGIILAALGGDVEKRGDREEAHVPFFSVMLIGGNIEVHVNPGDGTGLRKALLHAPTGTCSDGQAHSISLVRNRRIITVQLDENNPVEMKLGTLVESRTINVSNLYVGGIPEGEGTSLLTMRRSFHGCIKNLIFNLELLDFNSAVGHEQVDLDTCWLSERPKLAPDAEDSKLLPEPRAFPEQCVVDAALEYVPGAHQFGLTQNSHFILPFNQSAVRKKLSVELSIRTFASSGLIYYMAHQNQADYAVLQLHGGRLHFMFDLGKGRTKVSHPALLSDGKWHTVKTDYVKRKGFITVDGRESPMVTVVGDGTMLDVEGLFYLGGLPSQYQARKIGNITHSIPACIGDVTVNSKQLDKDSPVSAFTVNRCYAVAQEGTYFDGSGYAALVKEGYKVQSDVNITLEFRTSSQNGVLLGISTAKVDAIGLELVDGKVLFHVNNGAGRITAAYEPKTATVLCDGKWHTLQANKSKHRITLIVDGNAVGAESPHTQSTSVDTNNPIYVGGYPAGVKQKCLRSQTSFRGCLRKLALIKSPQVQSFDFSRAFELHGVFLHSCPGTES

SEQ ID NO: 105 - protein, 158 aa, Homo sapiens
MGKISSLPTQLFKCCFCDFLKVKMHTMSSSHLFYLALCLLTFTSSATAGPETLCGAELVDALQFVCGDRGFYFNKPTGYGSSSRRAPQTGIVDECCFRSCDLRRLEMYCAPLKPAKSARSVRAQRHTDMPKTQKYQPPSTNKNTKSQRRKGSTFEERK

SEQ ID NO: 106 - protein, 155 aa, Homo sapiens
MAEGEITTFTALTEKFNLPPGNYKKPKLLYCSNGGHFLRILPDGTVDGTRDRSDQHIQLQLSAESVGEVYIKSTETGQYLAMDTDGLLYGSQTPNEECLFLERLEENHYNTYISKKHAEKNWFVGLKKNGSCKRGPRTHYGQKAILFLPLPVSSD

SEQ ID NO: 107 - protein, 288 aa, Homo sapiens
MVGVGGGDVEDVTPRPGGCQISGRGARGCNGIPGAAAWEAALPRRRPRRHPSVNPRSRAAGSPRTRGRRTEERPSGSRLGDRGRGRALPGGRLGGRGRGRAPERVGGRGRGRGTAAPRAAPAARGSRPGPAGTMAAGSITTLPALPEDGGSGAFPPGHFKDPKRLYCKNGGFFLRIHPDGRVDGVREKSDPHIKLQLQAEERGVVSIKGVCANRYLAMKEDGRLLASKCVTDECFFFERLESNNYNTYRSRKYTSWYVALKRTGQYKLGSKTGPGQKAILFLPMSAKS

SEQ ID NO: 108 - protein, 390 aa, Homo sapiens
MPPSGLRLLPLLLPLLWLLVLTPGRPAAGLSTCKTIDMELVKRKRIEAIRGQILSKLRLASPPSQGEVPPGPLPEAVLALYNSTRDRVAGESAEPEPEPEADYYAKEVTRVLMVETHNEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGEIEGFRLSAHCSCDSRDNTLQVDINGFTTGRRGDLATIHGMNRPFLLLMATPLERAQHLQSSRHRRALDTNYCFSSTEKNCCVRQLYIDFRKDLGWKWIHEPKGYHANFCLGPCPYIWSLDTQYSKVLALYNQHNPGASAAPCCVPQALEPLPIVYYVGRKPKVEQLSNMIVRSCKCS

SEQ ID NO: 109 - protein, 442 aa, Homo sapiens
MHYCVLSAFLILHLVTVALSLSTCSTLDMDQFMRKRIEAIRGQILSKLKLTSPPEDYPEPEEVPPEVISIYNSTRDLLQEKASRRAAACERERSDEEYYAKEVYKIDMPPFFPSETVCPVVTTPSGSVGSLCSRQSQVLCGYLDAIPPTFYRPYFRIVRFDVSAMEKNASNLVKAEFRVFRLQNPKARVPEQRIELYQILKSKDLTSPTQRYIDSKVVKTRAEGEWLSFDVTDAVHEWLHHKDRNLGFKISLHCPCCTFVPSNNYIIPNKSEELEARFAGIDGTSTYTSGDQKTIKSTRKKNSGKTPHLLLMLLPSYRLESQQTNRRKKRALDAAYCFRNVQDNCCLRPLYIDFKRDLGWKWIHEPKGYNANFCAGACPYLWSSDTQHSRVLSLYNTINPEASASPCCVSQDLEPLTILYYIGKTPKIEQLSNMIVKSCKCS

SEQ ID NO: 110 - protein, 414 aa, Homo sapiens
MHYCVLSAFLILHLVTVALSLSTCSTLDMDQFMRKRIEAIRGQILSKLKLTSPPEDYPEPEEVPPEVISIYNSTRDLLQEKASRRAAACERERSDEEYYAKEVYKIDMPPFFPSENAIPPTFYRPYFRIVRFDVSAMEKNASNLVKAEFRVFRLQNPKARVPEQRIELYQILKSKDLTSPTQRYIDSKVVKTRAEGEWLSFDVTDAVHEWLHHKDRNLGFKISLHCPCCTFVPSNNYIIPNKSEELEARFAGIDGTSTYTSGDQKTIKSTRKKNSGKTPHLLLMLLPSYRLESQQTNRRKKRALDAAYCFRNVQDNCCLRPLYIDFKRDLGWKWIHEPKGYNANFCAGACPYLWSSDTQHSRVLSLYNTINPEASASPCCVSQDLEPLTILYYIGKTPKIEQLSNMIVKSCKCS

SEQ ID NO: 111 - protein, 377 aa, Homo sapiens
MCDEDETTALVCDNGSGLVKAGFAGDDAPRAVFPSIVGRPRHQGVMVGMGQKDSYVGDEAQSKRGILTLKYPIEHGIITNWDDMEKIWHHTFYNELRVAPEEHPTLLTEAPLNPKANREKMTQIMFETFNVPAMYVAIQAVLSLYASGRTTGIVLDSGDGVTHNVPIYEGYALPHAIMRLDLAGRDLTDYLMKILTERGYSFVTTAEREIVRDIKEKLCYVALDFENEMATAASSSSLEKSYELPDGQVITIGNERFRCPETLFQPSFIGMESAGIHETTYNSIMKCDIDIRKDLYANNVMSGGTTMYPGIADRMQKEITALAPSTMKIKIIAPPERKYSVWIGGSILASLSTFQQMWITKQEYDEAGPSIVHRKCF

SEQ ID NO: 112 - protein, 377 aa, Homo sapiens
MCEEEDSTALVCDNGSGLCKAGFAGDDAPRAVFPSIVGRPRHQGVMVGMGQKDSYVGDEAQSKRGILTLKYPIEHGIITNWDDMEKIWHHSFYNELRVAPEEHPTLLTEAPLNPKANREKMTQIMFETFNVPAMYVAIQAVLSLYASGRTTGIVLDSGDGVTHNVPIYEGYALPHAIMRLDLAGRDLTDYLMKILTERGYSFVTTAEREIVRDIKEKLCYVALDFENEMATAASSSSLEKSYELPDGQVITIGNERFRCPETLFQPSFIGMESAGIHETTYNSIMKCDIDIRKDLYANNVLSGGTTMYPGIADRMQKEITALAPSTMKIKIIAPPERKYSVWIGGSILASLSTFQQMWISKQEYDEAGPSIVHRKCF

SEQ ID NO: 113 - protein, 375 aa, Homo sapiens
MDDDIAALVVDNGSGMCKAGFAGDDAPRAVFPSIVGRPRHQGVMVGMGQKDSYVGDEAQSKRGILTLKYPIEHGIVTNWDDMEKIWHHTFYNELRVAPEEHPVLLTEAPLNPKANREKMTQIMFETFNTPAMYVAIQAVLSLYASGRTTGIVMDSGDGVTHTVPIYEGYALPHAILRLDLAGRDLTDYLMKILTERGYSFTTTAEREIVRDIKEKLCYVALDFEQEMATAASSSSLEKSYELPDGQVITIGNERFRCPEALFQPSFLGMESCGIHETTFNSIMKCDVDIRKDLYANTVLSGGTTMYPGIADRMQKEITALAPSTMKIKIIAPPERKYSVWIGGSILASLSTFQQMWISKQEYDESGPSIVHRKCF

SEQ ID NO: 114 - protein, 377 aa, Homo sapiens
MCDDEETTALVCDNGSGLVKAGFAGDDAPRAVFPSIVGRPRHQGVMVGMGQKDSYVGDEAQSKRGILTLKYPIEHGIITNWDDMEKIWHHTFYNELRVAPEEHPTLLTEAPLNPKANREKMTQIMFETFNVPAMYVAIQAVLSLYASGRTTGIVLDSGDGVTHNVPIYEGYALPHAIMRLDLAGRDLTDYLMKILTERGYSFVTTAEREIVRDIKEKLCYVALDFENEMATAASSSSLEKSYELPDGQVITIGNERFRCPETLFQPSFIGMESAGIHETTYNSIMKCDIDIRKDLYANNVLSGGTTMYPGIADRMQKEITALAPSTMKIKIIAPPERKYSVWIGGSILASLSTFQQMWISKQEYDEAGPSIVHRKCF

SEQ ID NO: 115 - protein, 375 aa, Homo sapiens
MEEEIAALVIDNGSGMCKAGFAGDDAPRAVFPSIVGRPRHQGVMVGMGQKDSYVGDEAQSKRGILTLKYPIEHGIVTNWDDMEKIWHHTFYNELRVAPEEHPVLLTEAPLNPKANREKMTQIMFETFNTPAMYVAIQAVLSLYASGRTTGIVMDSGDGVTHTVPIYEGYALPHAILRLDLAGRDLTDYLMKILTERGYSFTTTAEREIVRDIKEKLCYVALDFEQEMATAASSSSLEKSYELPDGQVITIGNERFRCPEALFQPSFLGMESCGIHETTFNSIMKCDVDIRKDLYANTVLSGGTTMYPGIADRMQKEITALAPSTMKIKIIAPPERKYSVWIGGSILASLSTFQQMWISKQEYDESGPSIVHRKCF

SEQ ID NO: 116 - protein, 376 aa, Homo sapiens
MCEEETTALVCDNGSGLCKAGFAGDDAPRAVFPSIVGRPRHQGVMVGMGQKDSYVGDEAQSKRGILTLKYPIEHGIITNWDDMEKIWHHSFYNELRVAPEEHPTLLTEAPLNPKANREKMTQIMFETFNVPAMYVAIQAVLSLYASGRTTGIVLDSGDGVTHNVPIYEGYALPHAIMRLDLAGRDLTDYLMKILTERGYSFVTTAEREIVRDIKEKLCYVALDFENEMATAASSSSLEKSYELPDGQVITIGNERFRCPETLFQPSFIGMESAGIHETTYNSIMKCDIDIRKDLYANNVLSGGTTMYPGIADRMQKEITALAPSTMKIKIIAPPERKYSVWIGGSILASLSTFQQMWISKPEYDEAGPSIVHRKCF

SEQ ID NO: 117 - protein, 333 aa, Homo sapiens
MCEEETTALVCDNGSGLCKAGFAGDDAPRAVFPSIVGRPRHQIWHHSFYNELRVAPEEHPTLLTEAPLNPKANREKMTQIMFETFNVPAMYVAIQAVLSLYASGRTTGIVLDSGDGVTHNVPIYEGYALPHAIMRLDLAGRDLTDYLMKILTERGYSFVTTAEREIVRDIKEKLCYVALDFENEMATAASSSSLEKSYELPDGQVITIGNERFRCPETLFQPSFIGMESAGIHETTYNSIMKCDIDIRKDLYANNVLSGGTTMYPGIADRMQKEITALAPSTMKIKIIAPPERKYSVWIGGSILASLSTFQQMWISKPEYDEAGPSIVHRKCF

SEQ ID NO: 118 - protein, 207 aa, Homo sapiens
MAGPATQSPMKLMALQLLLWHSALWTVQEATPLGPASSLPQSFLLKCLEQVRKIQGDGAALQEKLVSECATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 119 - protein, 204 aa, Homo sapiens
MAGPATQSPMKLMALQLLLWHSALWTVQEATPLGPASSLPQSFLLKCLEQVRKIQGDGAALQEKLCATYKLCHPEELVLLGHSLGIPWAPLSSCPSQALQLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 120 - protein, 171 aa, Homo sapiens
MAGPATQSPMKLMALQLLLWHSALWTVQEATPLGPASSLPQSFLLKCLEQVRKIQGDGAALQEKLVSEAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 121 - protein, 168 aa, Homo sapiens
MAGPATQSPMKLMALQLLLWHSALWTVQEATPLGPASSLPQSFLLKCLEQVRKIQGDGAALQEKLAGCLSQLHSGLFLYQGLLQALEGISPELGPTLDTLQLDVADFATTIWQQMEELGMAPALQPTQGAMPAFASAFQRRAGGVLVASHLQSFLEVSYRVLRHLAQP

SEQ ID NO: 122 - protein, 211 aa, Homo sapiens [sequence omitted]

SEQ ID NO: 123 - protein, 196 aa, Homo sapiens
MRTLACLLLLGCGYLAHVLAEEAEIPREVIERLARSQIHSIRDLQRLLEIDSVGSEDSLDTSLRAHGVHATKHVPEKRPLPIRRKRSIEEAVPAVCKTRTVIYEIPRSQVDPTSANFLIWPPCVEVKRCTGCCNTSSVKCQPSRVHHRSVKVAKVEYVRKKPKLKEVQVRLEEHLECACATTSLNPDYREEDTDVR

SEQ ID NO: 124 - protein, 241 aa, Homo sapiens
MNRCWALFLSLCCYLRLVSAEGDPIPEELYEMLSDHSIRSFDDLQRLLHGDPGEEDGAELDLNMTRSHSGGELESLARGRRSLGSLTIAEPAMIAECKTRTEVFEISRRLIDRTNANFLVWPPCVEVQRCSGCCNNRNVQCRPTQVQLRPVQVRKIEIVRKKPIFKKATVTLEDHLACKCETVAAARPVTRSPGGSQEQRAKTPQTRVTIRTVRVRRPPKGKHRKFKHTHDKTALKETLGA

SEQ ID NO: 125 - protein, 226 aa, Homo sapiens
MFIMGLGDPIPEELYEMLSDHSIRSFDDLQRLLHGDPGEEDGAELDLNMTRSHSGGELESLARGRRSLGSLTIAEPAMIAECKTRTEVFEISRRLIDRTNANFLVWPPCVEVQRCSGCCNNRNVQCRPTQVQLRPVQVRKIEIVRKKPIFKKATVTLEDHLACKCETVAAARPVTRSPGGSQEQRAKTPQTRVTIRTVRVRRPPKGKHRKFKHTHDKTALKETLGA

SEQ ID NO: 126 - protein, 345 aa, Homo sapiens
MSLFGLLLLTSALAGQRQGTQAESNLSSKFQFSSNKEQNGVQDPQHERIITVSTNGSIHSPRFPHTYPRNTVLVWRLVAVEENVWIQLTFDERFGLEDPEDDICKYDFVEVEEPSDGTILGRWCGSGTVPGKQISKGNQIRIRFVSDEYFPSEPGFCIHYNIVMPQFTEAVSPSVLPPSALPLDLLNNAITAFSTLEDLIRYLEPERWQLDLEDLYRPTWQLLGKAFVFGRKSRVVDLNLLTEEVRLYSCTPRNFSVSIREELKRTDTIFWPGCLLVKRCGGNCACCLHNCNECQCVPSKVTKKYHEVLQLRPKTGVRGLHKSLTDVALEHHEECDCVCRGSTGG

SEQ ID NO: 127 - protein, 370 aa, Homo sapiens
MHRLIFVYTLICANFCSCRDTSATPQSASIKALRNANLRRDESNHLTDLYRRDETIQVKGNGYVQSPRFPNSYPRNLLLTWRLHSQENTRIQLVFDNQFGLEEAENDICRYDFVEVEDISETSTIIRGRWCGHKEVPPRIKSRTNQIKITFKSDDYFVAKPGFKIYYSLLEDFQPAAASETNWESVTSSISGVSYNSPSVTDPTLIADALDKKIAEFDTVEDLLKYFNPESWQEDLENMYLDTPRYRGRSYHDRKSKVDLDRLNDDAKRYSCTPRNYSVNIREELKLANVVFFPRCLLVQRCGGNCGCGTVNWRSCTCNSGKTVKKYHEVLQFEPGHIKRRGRAKTMALVDIQLDHHERCDCICSSRPPR

SEQ ID NO: 128 - protein, 364 aa, Homo sapiens
MHRLIFVYTLICANFCSCRDTSATPQSASIKALRNANLRRDDLYRRDETIQVKGNGYVQSPRFPNSYPRNLLLTWRLHSQENTRIQLVFDNQFGLEEAENDICRYDFVEVEDISETSTIIRGRWCGHKEVPPRIKSRTNQIKITFKSDDYFVAKPGFKIYYSLLEDFQPAAASETNWESVTSSISGVSYNSPSVTDPTLIADALDKKIAEFDTVEDLLKYFNPESWQEDLENMYLDTPRYRGRSYHDRKSKVDLDRLNDDAKRYSCTPRNYSVNIREELKLANVVFFPRCLLVQRCGGNCGCGTVNWRSCTCNSGKTVKKYHEVLQFEPGHIKRRGRAKTMALVDIQLDHHERCDCICSSRPPR

SEQ ID NO: 129 - protein, 469 aa, Homo sapiens
MHSFPPLLLLLFWGVVSHSFPATLETQEQDVDLVQKYLEKYYNLKNDGRQVEKRRNSGPVVEKLKQMQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 130 - protein, 403 aa, Homo sapiens
MQEFFGLKVTGKPDAETLKVMKQPRCGVPDVAQFVLTEGNPRWEQTHLTYRIENYTPDLPRADVDHAIEKAFQLWSNVTPLTFTKVSEGQADIMISFVRGDHRDNSPFDGPGGNLAHAFQPGPGIGGDAHFDEDERWTNNFREYNLHRVAAHELGHSLGLSHSTDIGALMYPSYTFSGDVQLAQDDIDGIQAIYGRSQNPVQPIGPQTPKACDSKLTFDAITTIRGEVMFFKDRFYMRTNPFYPEVELNFISVFWPQLPNGLEAAYEFADRDEVRFFKGNKYWAVQGQNVLHGYPKDIYSSFGFPRTVKHIDAALSEENTGKTYFFVANKYWRYDEYKRSMDPGYPKMIAHDFPGIGHKVDAVFMKDGFFYFFHGTRQYKFDPKTKRILTLQKANSWFNCRKN

SEQ ID NO: 131 - protein, 467 aa, Homo sapiens [sequence omitted]

SEQ ID NO: 132 - protein, 476 aa, Homo sapiens
MMHLAFLVLLCLPVCSAYPLSGAAKEEDSNKDLAQQYLEKYYNLEKDVKQFRRKDSNLIVKKIQGMQKFLGLEVTGKLDTDTLEVMRKPRCGVPDVGHFSSFPGMPKWRKTHLTYRIVNYTPDLPRDAVDSAIEKALKVWEEVTPLTFSRLYEGEADIMISFAVKEHGDFYSFDGPGHSLAHAYPPGPGLYGDIHFDDDEKWTEDASGTNLFLVAAHELGHSLGLFHSANTEALMYPLYNSFTELAQFRLSQDDVNGIQSLYGPPPASTEEPLVPTKSVPSGSEMPAKCDPALSFDAISTLRGEYLFFKDRYFWRRSHWNPEPEFHLISAFWPSLPSYLDAAYEVNSRDTVFIFKGNEFWAIRGNEVQAGYPRGIHTLGFPPTIRKIDAAVSDKEKKKTYFFAADKYWRFDENSQSMEQGFPRLIADDFPGVEPKVDAVLQAFGFFYFFSGSSQFEFDPNARMVTHILKSNSWLHC

SEQ ID NO: 133 - protein, 470 aa, Homo sapiens
MKFLLILLLQATASGALPLNSSTSLEKNNVLFGERYLEKFYGLEINKLPVTKMKYSGNLMKEKIQEMQHFLGLKVTGQLDTSTLEMMHAPRCGVPDVHHFREMPGGPVWRKHYITYRINNYTPDMNREDVDYAIRKAFQVWSNVTPLKFSKINTGMADILVVFARGAHGDFHAFDGKGGILAHAFGPGSGIGGDAHFDEDEFWTTHSGGTNLFLTAVHEIGHSLGLGHSSDPKAVMFPTYKYVDINTFRLSADDIRGIQSLYGDPKENQRLPNPDNSEPALCDPNLSFDAVTTVGNKIFFFKDRFFWLKVSERPKTSVNLISSLWPTLPSGIEAAYEIEARNQVFLFKDDKYWLISNLRPEPNYPKSIHSFGFPNFVKKIDAAVFNPRFYRTYFFVDNQYWRYDERRQMMDPGYPKLITKNFQGIGPKIDAVFYSKNKYYYFFQGSNQFEYDFLLQRITKTLKSNSWFGC

SEQ ID NO: 134 - protein, 2871 aa, Homo sapiens
MRRGRLLEIALGFTVLLASYTSHGADANLEAGNVKETRASRAKRRGGGGHDALKGPNVCGSRYNAYCCPGWKTLPGGNQCIVPICRHSCGDGFCSRPNMCTCPSGQIAPSCGSRSIQHCNIRCMNGGSCSDDHCLCQKGYIGTHCGQPVCESGCLNGGRCVAPNRCACTYGFTGPQCERDYRTGPCFTVISNQMCQGQLSGIVCTKTLCCATVGRAWGHPCEMCPAQPHPCRRGFIPNIRTGACQDVDECQAIPGLCQGGNCINTVGSFECKCPAGHKLNEVSQKCEDIDECSTIPGICEGGECTNTVSSYFCKCPPGFYTSPDGTRCIDVRPGYCYTALTNGRCSNQLPQSITKMQCCCDAGRCWSPGVTVAPEMCPIRATEDFNKLCSVPMVIPGRPEYPPPPLGPIPPVLPVPPGFPPGPQIPVPRPPVEYLYPSREPPRVLPVNVTDYCQLVRYLCQNGRCIPTPGSYRCECNKGFQLDLRGECIDVDECEKNPCAGGECINNQGSYTCQCRAGYQSTLTRTECRDIDECLQNGRICNNGRCINTDGSFHCVCNAGFHVTRDGKNCEDMDECSIRNMCLNGMCINEDGSFKCICKPGFQLASDGRYCKDINECETPGICMNGRCVNTDGSYRCECFPGLAVGLDGRVCVDTHMRSTCYGGYKRGQCIKPLFGAVTKSECCCASTEYAFGEPCQPCPAQNSAEYQALCSSGPGMTSAGSDINECALDPDICPNGICENLRGTYKCICNSGYEVDSTGKNCVDINECVLNSLLCDNGQCRNTPGSFVCTCPKGFIYKPDLKTCEDIDECESSPCINGVCKNSPGSFICECSSESTLDPTKTICIETIKGTCWQTVIDGRCEININGATLKSQCCSSLGAAWGSPCTLCQVDPICGKGYSRIKGTQCEDIDECEVFPGVCKNGLCVNTRGSFKCQCPSGMTLDATGRICLDIRLETCFLRYEDEECTLPIAGRHRMDACCCSVGAAWGTEECEECPMRNTPEYEELCPRGPGFATKEITNGKPFFKDINECKMIPSLCTHGKCRNTIGSFKCRCDSGFALDSEERNCTDIDECRISPDLCGRGQCVNTPGDFECKCDEGYESGFMMMKNCMDIDECQRDPLLCRGGVCHNTEGSYRCECPPGHQLSPNISACIDINECELSAHLCPNGRCVNLIGKYQCACNPGYHSTPDRLFCVDIDECSIMNGGCETFCTNSEGSYECSCQPGFALMPDQRSCTDIDECEDNPNICDGGQCTNIPGEYRCLCYDGFMASEDMKTCVDVNECDLNPNICLSGTCENTKGSFICHCDMGYSGKKGKTGCTDINECEIGAHNCGKHAVCTNTAGSFKCSCSPGWIGDGIKCTDLDECSNGTHMCSQHADCKNTMGSYRCLCKEGYTGDGFTCTDLDECSENLNLCGNGQCLNAPGGYRCECDMGFVPSADGKACEDIDECSLPNICVFGTCHNLPGLFRCECEIGYELDRSGGNCTDVNECLDPTTCISGNCVNTPGSYICDCPPDFELNPTRVGCVDTRSGNCYLDIRPRGDNGDTACSNEIGVGVSKASCCCSLGKAWGTPCEMCPAVNTSEYKILCPGGEGFRPNPITVILEDIDECQELPGLCQGGKCINTFGSFQCRCPTGYYLNEDTRVCDDVNECETPGICGPGTCYNTVGNYTCICPPDYMQVNGGNNCMDMRRSLCYRNYYADNQTCDGELLFNMTKKMCCCSYNIGRAWNKPCEQCPIPSTDEFATLCGSQRPGFVIDIYTGLPVDIDECREIPGVCENGVCINMVGSFRCECPVGFFYNDKLLVCEDIDECQNGPVCQRNAECINTAGSYRCDCKPGYRFTSTGQCNDRNECQEIPNICSHGQCIDTVGSFYCLCHTGFKTNDDQTMCLDINECERDACGNGTCRNTIGSFNCRCNHGFILSHNNDCIDVDECASGNGNLCRNGQCINTVGSFQCQCNEGYEVAPDGRTCVDINECLLEPRKCAPGTCQNLDGSYRCICPPGYSLQNEKCEDIDECVEEPEICALGTCSNTEGSFKCLCPEGFSLSSSGRRCQDLRMSYCYAKFEGGKCSSPKSRNHSKQECCCALKGEGWGDPCELCPTEPDEAFRQICPYGSGIIVGPDDSAVDMDECKEPDVCKHGQCINTDGSYRCECPFGYILAGNECVDTDECSVGNPCGNGTCKNVIGGFECTCEEGFEPGPMMTCEDINECAQNPLLCAFRCVNTYGSYECKCPVGYVLREDRRMCKDEDECEEGKHDCTEKQMECKNLIGTYMCICGPGYQRRPDGEGCVDENECQTKPGICENGRCLNTRGSYTCECNDGFTASPNQDECLDNREGYCFTEVLQNMCQIGSSNRNPVTKSECCCDGGRGWGPHCEICPFQGTVAFKKLCPHGRGFMTNGADIDECKVIHDVCRNGECVNDRGSYHCICKTGYTPDITGTSCVDLNECNQAPKPCNFICKNTEGSYQCSCPKGYILQEDGRSCKDLDECATKQHNCQFLCVNTIGGFTCKCPPGFTQHHTSCIDNNECTSDINLCGSKGICQNTPGSFTCECQRGFSLDQTGSSCEDVDECEGNHRCQHGCQNIIGGYRCSCPQGYLQHYQWNQCVDENECLSAHICGGASCHNTLGSYKCMCPAGFQYEQFSGGCQDINECGSAQAPCSYGCSNTEGGYLCGCPPGYFRIGQGHCVSGMGMGRGNPEPPVSGEMDDNSLSPEACYECKINGYPKRGRKRRSTNETDASNIEDQSETEANVSLASWDVEKTAIFAFNISHVSNKVRILELLPALTTLTNHNRYLIESGNEDGFFKINQKEGISYLHFTKKKPVAGTYSLQISSTPLYKKKELNQLEDKYDKDYLSGELGDNLKMKIQVLLH

SEQ ID NO: 135 - protein, 2912 aa, Homo sapiens
MGRRRRLCLQLYFLWLGCVVLWAQGTAGQPQPPPPKPPRPQPPPQQVRSATAGSEGGFLAPEYREEGAAVASRVRRRGQQDVLRGPNVCGSRFHSYCCPGWKTLPGGNQCIVPICRNSCGDGFCSRPNMCTCSSGQISSTCGSKSIQQCSVRCMNGGTCADDHCQCQKGYIGTYCGQPVCENGCQNGGRCIGPNRCACVYGFTGPQCERDYRTGPCFTQVNNQMCQGQLTGIVCTKTLCCATIGRAWGHPCEMCPAQPQPCRRGFIPNIRTGACQDVDECQAIPGICQGGNCINTVGSFECRCPAGHKQSETTQKCEDIDECSIIPGICETGECSNTVGSYFCVCPRGYVTSTDGSRCIDQRTGMCFSGLVNGRCAQELPGRMTKMQCCCEPGRCWGIGTIPEACPVRGSEEYRRLCMDGLPMGGIPGSAGSRPGGTGGNGFAPSGNGNGYGPGGTGFIPIPGGNGFSPGVGGAGVGAGGQGPIITGLTILNQTIDICKHHANLCLNGRCIPTVSSYRCECNMGYKQDANGDCIDVDECTSNPCTNGDCVNTPGSYYCKCHAGFQRTPTKQACIDIDECIQNGVLCKNGRCVNTDGSFQCICNAGFELTTDGKNCVDHDECTTTNMCLNGMCINEDGSFKCICKPGFVLAPNGRYCTDVDECQTPGICMNGHCINSEGSFRCDCPPGLAVGMDGRVCVDTHMRSTCYGGIKKGVCVRPFPGAVTKSECCCANPDYGFGEPCQPCPAKNSAEFHGLCSSGVGITVDGRDINECALDPDICANGICENLRGSYRCNCNSGYEPDASGRNCIDIDECLVNRLLCDNGLCRNTPGSYSCTCPPGYVFRTETETCEDINECESNPCVNGACRNNLGSFNCECSPGSKLSSTGLICIDSLKGTCWLNIQDSRCEVNINGATLKSECCATLGAAWGSPCERCELDTACPRGLARIKGVTCEDVNECEVFPGVCPNGRCVNSKGSFHCECPEGLTLDGTGRVCLDIRMEQCYLKWDEDECIHPVPGKFRMDACCCAVGAAWGTECEECPKPGTKEYETLCPRGAGFANRGDVLTGRPFYKDINECKAFPGMCTYGKCRNTIGSFKCRCNSGFALDMEERNCTDIDECRISPDLCGSGICVNTPGSFECECFEGYESGFMMMKNCMDIDECERNPLLCRGGTCVNTEGSFQCDCPLGHELSPSREDCVDINECSLSDNLCRNGKCVNMIGTYQCSCNPGYQATPDRQGCTDIDECMIMNGGCDTQCTNSEGSYECSCSEGYALMPDGRSCADIDECENNPDICDGGQCTNIPGEYRCLCYDGFMASMDMKTCIDVNECDLNSNICMFGECENTKGSFICHCQLGYSVKKGTTGCTDVDECEIGAHNCDMHASCLNIPGSFKCSCREGWIGNGIKCIDLDECSNGTHQCSINAQCVNTPGSYRCACSEGFTGDGFTCSDVDECAENINLCENGQCLNVPGAYRCECEMGFTPASDSRSCQDIDECSFQNICVFGTCNNLPGMFHCICDDGYELDRTGGNCTDIDECADPINCVNGLCVNTPGRYECNCPPDFQLNPTGVGCVDNRVGNCYLKFGPRGDGSLSCNTEIGVGVSRSSCCCSLGKAWGNPCETCPPVNSTEYYTLCPGGEGFRPNPITIILEDIDECQELPGLCQGGNCINTFGSFQCECPQGYYLSEDTRICEDIDECFAHPGVCGPGTCYNTLGNYTCICPPEYMQVNGGHNCMDMRKSFCYRSYNGTTCENELPFNVTKRMCCCTYNVGKAWNKPCEPCPTPGTADFKTICGNIPGFTFDIHTGKAVDIDECKEIPGICANGVCINQIGSFRCECPTGFSYNDLLLVCEDIDECSNGDNLCQRNADCINSPGSYRCECAAGFKLSPNGACVDRNECLEIPNVCSHGLCVDLQGSYQCICHNGFKASQDQTMCMDVDECERHPCGNGTCKNTVGSYNCLCYPGFELTHNNDCLDIDECSSFFGQVCRNGRCFNEIGSFKCLCNEGYELTPDGKNCIDTNECVALPGSCSPGTCQNLEGSFRCICPPGYEVKSENCIDINECDEDPNICLFGSCTNTPGGFQCLCPPGFVLSDNGRRCFDTRQSFCFTNFENGKCSVPKAFNTTKAKCCCSKMPGEGWGDPCELCPKDDEVAFQDLCPYGHGTVPSLHDTREDVNECLESPGICSNGQCINTDGSFRCECPMGYNLDYTGVRCVDTDECSIGNPCGNGTCTNVIGSFECNCNEGFEPGPMMNCEDINECAQNPLLCAFRCMNTFGSYECTCPIGYALREDQKMCKDLDECAEGLHDCESRGMMCKNLIGTFMCICPPGMARRPDGEGCVDENECRTKPGICENGRCVNIIGSYRCECNEGFQSSSSGTECLDNRQGLCFAEVLQTICQMASSSRNLVTKSECCCDGGRGWGHQCELCPLPGTAQYKKICPHGPGYTTDGRDIDECKVMPNLCTNGQCINTMGSFRCFCKVGYTTDISGTSCIDLDECSQSPKPCNYICKNTEGSYQCSCPRGYVLQEDGKTCKDLDECQTKQHNCQFLCVNTLGGFTCKCPPGFTQHHTACIDNNECGSQPSLCGAKGICQNTPGSFSCECQRGFSLDATGLNCEDVDECDGNHRCQHGCQNILGGYRCGCPQGYIQHYQWNQCVDENECSNPNACGSASCYNTLGSYKCACPSGFSFDQFSSACHDVNECSSSKNPCNYGCSNTEGGYLCGCPPGYYRVGQGHCVSGMGFNKGQYLSLDTEVDEENALSPEACYECKINGYSKKDSRQKRSIHEPDPTAVEQISLESVDMDSPVNMKFNLSHLGSKEHILELRPAIQPLNNHIRYVISQGNDDSVFRIHQRNGLSYLHTAKKKLMPGTYTLEITSIPLYKKKELKKLEESNEDDYLLGELGEALRMRLQIQLY

SEQ ID NO: 136 - protein, 574 aa, Homo sapiens
MALARGSRQLGALVWGACLCVLVHGQQAQPGQGSDPARWRQLIQWENNGQVYSLLNSGSEYVPAGPQRSESSSRVLLAGAPQAQQRRSHGSPRRRQAPSLPLPGRVGSDTVRGQARHPFGFGQVPDNWREVAVGDSTGMARARTSVSQQRHGGSASSVSASAFASTYRQQPSYPQQFPYPQAPFVSQYENYDPASRTYDQGFVYYRPAGGGVGAGAAAVASAGVIYPYQPRARYEEYGGGEELPEYPPQGFYPAPERPYVPPPPPPPDGLDRRYSHSLYSEGTPGFEQAYPDPGPEAAQAHGGDPRLGWYPPYANPPPEAYGPPRALEPPYLPVRSSDTPPPGGERNGAQQGRLSVGSVYRPNQNGRGLPDLVPDPNYVQASTYVQRAHLYSLRCAAEEKCLASTAYAPEATDYDVRVLLRFPQRVKNQGTADFLPNRPRHTWEWHSCHQHYHSMDEFSHYDLLDAATGKKVAEGHKASFCLEDSTCDFGNLKRYACTSHTQGLSPGCYDTYNADIDCQWIDITDVQPGNYILKVHVNPKYIVLESDFTNNVVRCNIHYTGRYVSATNCKIVQS

SEQ ID NO: 137 - protein, 774 aa, Homo sapiens
MERPLCSHLCSCLAMLALLSPLSLAQYDSWPHYPEYFQQPAPEYHQPQAPANVAKIQLRLAGQKRKHSEGRVEVYYDGQWGTVCDDDFSIHAAHVVCRELGYVEAKSWTASSSYGKGEGPIWLDNLHCTGNEATLAACTSNGWGVTDCKHTEDVGVVCSDKRIPGFKFDNSLINQIENLNIQVEDIRIRAILSTYRKRTPVMEGYVEVKEGKTWKQICDKHWTAKNSRVVCGMFGFPGERTYNTKVYKMFASRRKQRYWPFSMDCTGTEAHISSCKLGPQVSLDPMKNVTCENGLPAVVSCVPGQVFSPDGPSRFRKAYKPEQPLVRLRGGAYIGEGRVEVLKNGEWGTVCDDKWDLVSASVVCRELGFGSAKEAVTGSRLGQGIGPIHLNEIQCTGNEKSIIDCKFNAESQGCNHEEDAGVRCNTPAMGLQKKLRLNGGRNPYEGRVEVLVERNGSLVWGMVCGQNWGIVEAMVVCRQLGLGFASNAFQETWYWHGDVNSNKVVMSGVKCSGTELSLAHCRHDGEDVACPQGGVQYGAGVACSETAPDLVLNAEMVQQTTYLEDRPMFMLQCAMEENCLSASAAQTDPTTGYRRLLRFSSQIHNNGQSDFRPKNGRHAWIWHDCHRHYHSMEVFTHYDLLNLNGTKVAEGHKASFCLEDTECEGDIQKNYECANFGDQGITMGCWDMYRHDIDCQWVDITDVPPGDYLFQVVINPNFEVAESDYSNNIMKCRSRYDGHRIWMYNCHIGGSFSEETEKKFEHFSGLLNNQLSPQ

SEQ ID NO: 138 - protein, 753 aa, Homo sapiens
MRPVSVWQWSPWGLLLCLLCSSCLGSPSPSTGPEKKAGSQGLRFRLAGFPRKPYEGRVEIQRAGEWGTICDDDFTLQAAHILCRELGFTEATGWTHSAKYGPGTGRIWLDNLSCSGTEQSVTECASRGWGNSDCTHDEDAGVICKDQRLPGFSDSNVIEVEHHLQVEEVRIRPAVGWGRRPLPVTEGLVEVRLPDGWSQVCDKGWSAHNSHVVCGMLGFPSEKRVNAAFYRLLAQRQQHSFGLHGVACVGTEAHLSLCSLEFYRANDTARCPGGGPAVVSCVPGPVYAASSGQKKQQQSKPQGEARVRLKGGAHPGEGRVEVLKASTWGTVCDRKWDLHAASVVCRELGFGSAREALSGARMGQGMGAIHLSEVRCSGQELSLWKCPHKNITAEDCSHSQDAGVRCNLPYTGAETRIRLSGGRSQHEGRVEVQIGGPGPLRWGLICGDDWGTLEAMVACRQLGLGYANHGLQETWYWDSGNITEVVMSGVRCTGTELSLDQCAHHGTHITCKRTGTRFTAGVICSETASDLLLHSALVQETAYIEDRPLHMLYCAAEENCLASSARSANWPYGHRRLLRFSSQIHNLGRADFRPKAGRHSWVWHECHGHYHSMDIFTHYDILTPNGTKVAEGHKASFCLEDTECQEDVSKRYECANFGEQGITVGCWDLYRHDIDCQWIDITDVKPGNYILQVVINPNFEVAESDFTNNAMKCNCKYDGHRIWVHNCHIGDAFSEEANRRFERYPGQTSNQII

SEQ ID NO: 139 - protein, 608 aa, Homo sapiens
MRPVSVWQWSPWGLLLCLLCSSCLGSPSPSTGPEKKAGSQGLRFRLAGFPRKPYEGRVEIQRAGEWGTICDDDFTLQAAHILCRELGFTEATGWTHSAKYGPGTGRIWLDNLSCSGTEQSVTECASRGWGNSDCTHDEDAGVICKDQRLPGFSDSNVIEARVRLKGGAHPGEGRVEVLKASTWGTVCDRKWDLHAASVVCRELGFGSAREALSGARMGQGMGAIHLSEVRCSGQELSLWKCPHKNITAEDCSHSQDAGVRCNLPYTGAETRIRLSGGRSQHEGRVEVQIGGPGPLRWGLICGDDWGTLEAMVACRQLGLGYANHGLQETWYWDSGNITEVVMSGVRCTGTELSLDQCAHHGTHITCKRTGTRFTAGVICSETASDLLLHSALVQETAYIEDRPLHMLYCAAEENCLASSARSANWPYGHRRLLRFSSQIHNLGRADFRPKAGRHSWVWHECHGHYHSMDIFTHYDILTPNGTKVAEGHKASFCLEDTECQEDVSKRYECANFGEQGITVGCWDLYRHDIDCQWIDITDVKPGNYILQVVINPNFEVAESDFTNNAMKCNCKYDGHRIWVHNCHIGDAFSEEANRRFERYPGQTSNQII

SEQ ID NO: 140 - protein, 392 aa, Homo sapiens
MGQGMGAIHLSEVRCSGQELSLWKCPHKNITAEDCSHSQDAGVRCNLPYTGAETRIRLSGGRSQHEGRVEVQIGGPGPLRWGLICGDDWGTLEAMVACRQLGLGYANHGLQETWYWDSGNITEVVMSGVRCTGTELSLDQCAHHGTHITCKRTGTRFTAGVICSETASDLLLHSALVQETAYIEDRPLHMLYCAAEENCLASSARSANWPYGHRRLLRFSSQIHNLGRADFRPKAGRHSWVWHECHGHYHSMDIFTHYDILTPNGTKVAEGHKASFCLEDTECQEDVSKRYECANFGEQGITVGCWDLYRHDIDCQWIDITDVKPGNYILQVVINPNFEVAESDFTNNAMKCNCKYDGHRIWVHNCHIGDAFSEEANRRFERYPGQTSNQII

SEQ ID NO: 141 - protein, 756 aa, Homo sapiens
MAWSPPATLFLFLLLLGQPPPSRPQSLGTTKLRLVGPESKPEEGRLEVLHQGQWGTVCDDNFAIQEATVACRQLGFEAALTWAHSAKYGQGEGPIWLDNVRCVGTESSLDQCGSNGWGVSDCSHSEDVGVICHPRRHRGYLSETVSNALGPQGRRLEEVRLKPILASAKQHSPVTEGAVEVKYEGHWRQVCDQGWTMNNSRVVCGMLGFPSEVPVDSHYYRKVWDLKMRDPKSRLKSLTNKNSFWIHQVTCLGTEPHMANCQVQVAPARGKLRPACPGGMHAVVSCVAGPHFRPPKTKPQRKGSWAEEPRVRLRSGAQVGEGRVEVLMNRQWGTVCDHRWNLISASVVCRQLGFGSAREALFGARLGQGLGPIHLSEVRCRGYERTLSDCPALEGSQNGCQHENDAAVRCNVPNMGFQNQVRLAGGRIPEEGLLEVQVEVNGVPRWGSVCSENWGLTEAMVACRQLGLGFAIHAYKETWFWSGTPRAQEVVMSGVRCSGTELALQQCQRHGPVHCSHGGGRFLAGVSCMDSAPDLVMNAQLVQETAYLEDRPLSQLYCAHEENCLSKSADHMDWPYGYRRLLRFSTQIYNLGRTDFRPKTGRDSWVWHQCHRHYHSIEVFTHYDLLTLNGSKVAEGHKASFCLEDTNCPTGLQRRYACANFGEQGVTVGCWDTYRHDIDCQWVDITDVGPGNYIFQVIVNPHYEVAESDFSNNMLQCRCKYDGHRVWLHNCHTGNSYPANAELSLEQEQRLRNNLI

SEQ ID NO: 142 - protein, 183 aa, Homo sapiens
MRAAYLFLLFLPAGLLAQGQYDLDPLPPFPDHVQYTHYSDQIDNPDYYDYQEVTPRPSEEQFQFQSQQQVQQEVIPAPTPEPGNAELEPTEPGPLDCREEQYPCTRLYSIHRPCKQCLNEVCFYSLRRVYVINKEICVRTVCAHEELLRADLCRDKFSKCGVMASSGLCQSVAASCARSCGSC

SEQ ID NO: 143 - protein, 182 aa, Homo sapiens
MRAAYLFLLFLPGLLAQGQYDLDPLPPFPDHVQYTHYSDQIDNPDYYDYQEVTPRPSEEQFQFQSQQQVQQEVIPAPTPEPGNAELEPTEPGPLDCREEQYPCTRLYSIHRPCKQCLNEVCFYSLRRVYVINKEICVRTVCAHEELLRADLCRDKFSKCGVMASSGLCQSVAASCARSCGSC

SEQ ID NO: 144 - protein, 173 aa, Homo sapiens
MSLLGPKVLLFLAAFIITSDWIPLGVNSQRGDDVTQATPETFTEDPNLVNDPATDETVLAVLADIAPSTDDLASLSEKNTTAECWDEKFTCTRLYSVHRPVKQCIHQLCFTSLRRMYIVNKEICSRLVCKEHEAMKDELCRQMAGLPPRRLRRSNYFRLPPCENVDLQRPNGL

SEQ ID NO: 145 - protein, 824 aa, Homo sapiens
MRQSLLFLTSVVPFVLAPRPPDDPGFGPHQRLEKLDSLLSDYDILSLSNIQQHSVRKRDLQTSTHVETLLTFSALKRHFKLYLTSSTERFSQNFKVVVVDGKNESEYTVKWQDFFTGHVVGEPDSRVLAHIRDDDVIIRINTDGAEYNIEPLWRFVNDTKDKRMLVYKSEDIKNVSRLQSPKVCGYLKVDNEELLPKGLVDREPPEELVHRVKRRADPDPMKNTCKLLVVADHRFYRYMGRGEESTTTNYLIELIDRVDDIYRNTSWDNAGFKGYGIQIEQIRILKSPQEVKPGEKHYNMAKSYPNEEKDAWDVKMLLEQFSFDIAEEASKVCLAHLFTYQDFDMGTLGLAYVGSPRANSHGGVCPKAYYSPVGKKNIYLNSGLTSTKNYGKTILTKEADLVTTHELGHNFGAEHDPDGLAECAPNEDQGGKYVMYPIAVSGDHENNKMFSNCSKQSIYKTIESKAQECFQERSNKVCGNSRVDEGEECDPGIMYLNNDTCCNSDCTLKEGVQCSDRNSPCCKNCQFETAQKKCQEAINATCKGVSYCTGNSSECPPPGNAEDDTVCLDLGKCKDGKCIPFCEREQQLESCACNETDNSCKVCCRDLSGRCVPYVDAEQKNLFLRKGKPCTVGFCDMNGKCEKRVQDVIERFWDFIDQLSINTFGKFLADNIVGSVLVFSLIFWIPFSILVHCVDKKLDKQYESLSLFHPSNVEMLSSMDSASVRIIKPFPAPQTPGRLQPAPVIPSAPAAPKLDHQRMDTIQEDPSTDSHMDEDGFEKDPFPNSSTAAKSFEDLTDHPVTRSEKAASFKLQRQNRVDSKETEC

SEQ ID NO: 146 - protein, 824 aa, Homo sapiens; identical to SEQ ID NO: 145

SEQ ID NO: 147 - protein, 713 aa, Homo sapiens
MATGQDRVVALVDMDCFFVQVEQRQNPHLRNKPCAVVQYKSWKGGGIIAVSYEARAFGVTRSMWADDAKKLCPDLLLAQVRESRGKANLTKYREASVEVMEIMSRFAVIERASIDEAYVDLTSAVQERLQKLQGQPISADLLPSTYIEGLPQGPTTAEETVQKEGMRKQGLFQWLDSLQIDNLTSPDLQLTVGAVIVEEMRAAIERETGFQCSAGISHNKVLAKLACGLNKPNRQTLVSHGSVPQLFSQMPIRKIRSLGGKLGASVIEILGIEYMGELTQFTESQLQSHFGEKNGSWLYAMCRGIEHDPVKPRQLPKTIGCSKNFPGKTALATREQVQWWLLQLAQELEERLTKDRNDNDRVATQLVVSIRVQGDKRLSSLRRCCALTRYDAHKMSHDAFTVIKNCNTSGIQTEWSPPLTMLFLCATKFSASAPSSSTDITSFLSSDPSSLPKVPVTSSEAKTQGSGPAVTATKKATTSLESFFQKAAERQKVKEASLSSLTAPTQAPMSNSPSKPSLPFQTSQSTGTEPFFKQKSLLLKQKQLNNSSVSSPQQNPWSNCKALPNSLPTEYPGCVPVCEGVSKLEESSKATPAEMDLAHNSQSMHASSASKSVLEVTQKATPNPSLLAAEDQVPCEKCGSLVPVWDMPEHMDYHFALELQKSFLQPHSSNPQVVSAVSHQGKRNPKSPLACTNKRPRPEGMQTLESFFKPLTH

SEQ ID NO: 148 - protein, 589 aa, Homo sapiens
MKLVHLESLEVCGQMMLRSYVQIFYWHKFVSPVGKLTSPKGMRKQGLFQWLDSLQIDNLTSPDLQLTVGAVIVEEMRAAIERETGFQCSAGISHNKVLAKLACGLNKPNRQTLVSHGSVPQLFSQMPIRKIRSLGGKLGASVIEILGIEYMGELTQFTESQLQSHFGEKNGSWLYAMCRGIEHDPVKPRQLPKTIGCSKNFPGKTALATREQVQWWLLQLAQELEERLTKDRNDNDRVATQLVVSIRVQGDKRLSSLRRCCALTRYDAHKMSHDAFTVIKNCNTSGIQTEWSPPLTMLFLCATKFSASAPSSSTDITSFLSSDPSSLPKVPVTSSEAKTQGSGPAVTATKKATTSLESFFQKAAERQKVKEASLSSLTAPTQAPMSNSPSKPSLPFQTSQSTGTEPFFKQKSLLLKQKQLNNSSVSSPQQNPWSNCKALPNSLPTEYPGCVPVCEGVSKLEESSKATPAEMDLAHNSQSMHASSASKSVLEVTQKATPNPSLLAAEDQVPCEKCGSLVPVWDMPEHMDYHFALELQKSFLQPHSSNPQVVSAVSHQGKRNPKSPLACTNKRPRPEGMQTLESFFKPLTH

SEQ ID NO: 149 - protein, 414 aa, Homo sapiens
MATGQDRVVALVDMDCFFVQVEQRQNPHLRNKPCAVVQYKSWKGGGIIAVSYEARAFGVTRSMWADDAKKLCPDLLLAQVRESRGKANLTKYREASVEVMEIMSRFAVIERASIDEAYVDLTSAVQERLQKLQGQPISADLLPSTYIEGLPQGPTTAEETVQKEGMRKQGLFQWLDSLQIDNLTSPDLQLTVGAVIVEEMRAAIERETGFQCSAGISHNKVLAKLACGLNKPNRQTLVSHGSVPQLFSQMPIRKIRSLGGKLGASVIEILGIEYMGELTQFTESQLQSHFGEKNGSWLYAMCRGIEHDPVKPRQLPKTIGCSKNFPGKTALATREQVQWWLLQLAQELEERLTKDRNDNDRVATQLVVSIRVQGDKRLSSLRRCCALTRYDAHKMSHDAFTVIKNCNTSGIQTE

SEQ ID NO: 150 - protein, 429 aa, Homo sapiens
MRSLGANMAAALRAAGVLLRDPLASSSWRVCQPWRWKSGAAAAAVTTETAQHAQGAKPQVQPQKRYESNIRKPKTGILMLNMGGPETLGDVHDFLLRLFLDRDLMTLPIQNKLAPFIAKRRTPKIQEQYRRIGGGSPIKIWTSKQGEGMVKLLDELSPNTAPHKYYIGFRYVHPLTEEAIEEMERDGLERAIAFTQYPQYSCSTTGSSLNAIYRYYNQVGRKPTMKWSTIDRWPTHHLLIQCFADHILKELDHFPLEKRSEVVILFSAHSLPMSVVNRGDPYPQEVSATVQKVMERLEYCNPYRLVWQSKVGPMPWLGPQTDESIKGLCERGRKNILLVPIAFTSDHIETLYELDIEYSQVLAKECGVENIRRAESLNGNPLFSKALADLVHSHIQSNELCSKQLTLSCPLCVNPVCRETKSFFTSQQL

SEQ ID NO: 151 - protein, 423 aa, Homo sapiens
MRSLGANMAAALRAAGVLLRDPLASSSWRVCQPWRWKSGAAAAAVTTETAQHAQGAKPQVQPQKRKPKTGILMLNMGGPETLGDVHDFLLRLFLDRDLMTLPIQNKLAPFIAKRRTPKIQEQYRRIGGGSPIKIWTSKQGEGMVKLLDELSPNTAPHKYYIGFRYVHPLTEEAIEEMERDGLERAIAFTQYPQYSCSTTGSSLNAIYRYYNQVGRKPTMKWSTIDRWPTHHLLIQCFADHILKELDHFPLEKRSEVVILFSAHSLPMSVVNRGDPYPQEVSATVQKVMERLEYCNPYRLVWQSKVGPMPWLGPQTDESIKGLCERGRKNILLVPIAFTSDHIETLYELDIEYSQVLAKECGVENIRRAESLNGNPLFSKALADLVHSHIQSNELCSKQLTLSCPLCVNPVCRETKSFFTSQQL

SEQ ID NO: 152 - protein, 4061 aa, Homo sapiens
MSTLLENIFAIINLFKQYSKKDKNTDTLSKKELKELLEKEFRQILKNPDDPDMVDVFMDHLDIDHNKKIDFTEFLLMVFKLAQAYYESTRKENLPISGHKHRKHSHHDKHEDNKQEENKENRKRPSSLERRNNRKGNKGRSKSPRETGGKRHESSSEKKERKGYSPTHREEEYGKNHHNSSKKEKNKTENTRLGDNRKRLSERLEEKEDNEEGVYDYENTGRMTQKWIQSGHIATYYTIQDEAYDTTDSLLEENKIYERSRSSDGKSSSQVNRSRHENTSQVPLQESRTRKRRGSRVSQDRDSEGHSEDSERHSGSASRNHHGSAWEQSRDGSRHPRSHDEDRASHGHSADSSRQSGTRHAETSSRGQTASSHEQARSSPGERHGSGHQQSADSSRHSATGRGQASSAVSDRGHRGSSGSQASDSEGHSENSDTQSVSGHGKAGLRQQSHQESTRGRSGERSGRSGSSLYQVSTHEQPDSAHGRTGTSTGGRQGSHHEQARDSSRHSASQEGQDTIRGHPGSSRGGRQGSHHEQSVNRSGHSGSHHSHTTSQGRSDASHGQSGSRSASRQTRNEEQSGDGTRHSGSRHHEASSQADSSRHSQVGQGQSSGPRTSRNQGSSVSQDSDSQGHSEDSERWSGSASRNHHGSAQEQSRDGSRHPRSHHEDRAGHGHSADSSRKSGTRHTQNSSSGQAASSHEQARSSAGERHGSRHQLQSADSSRHSGTGHGQASSAVRDSGHRGSSGSQATDSEGHSEDSDTQSVSGHGQAGHHQQSHQESARDRSGERSRRSGSFLYQVSTHKQSESSHGWTGPSTGVRQGSHHEQARDNSRHSASQDGQDTIRGHPGSSRRGRQGSHHEQSVDRSGHSGSHHSHTTSQGRSDASRGQSGSRSASRTTRNEEQSRDGSRHSGSRHHEASSHADISRHSQAGQGQSEGSRTSRRQGSSVSQDSDSEGHSEDSERWSGSASRNHRGSAQEQSRHGSRHPRSHHEDRAGHGHSADSSRQSGTPHAETSSGGQAASSHEQARSSPGERHGSRHQQSADSSRHSGIPRRQASSAVRDSGHWGSSGSQASDSEGHSEESDTQSVSGHGQDGPHQQSHQESARDWSGGRSGRSGSFIYQVSTHEQSESAHGRTRTSTGRRQGSHHEQARDSSRHSASQEGQDTIRAHPGSRRGGRQGSHHEQSVDRSGHSGSHHSHTTSQGRSDASHGQSGSRSASRQTRKDKQSGDGSRHSGSRHHEAASWADSSRHSQVGQEQSSGSRTSRHQGSSVSQDSDSERHSDDSERLSGSASRNHHGSSREQSRDGSRHPGFHQEDRASHGHSADSSRQSGTHHTESSSHGQAVSSHEQARSSPGERHGSRHQQSADSSRHSGIGHRQASSAVRDSGHRGSSGSQVTNSEGHSEDSDTQSVSAHGQAGPHQQSHKESARGQSGESSGRSRSFLYQVSSHEQSESTHGQTAPSTGGRQGSRHEQARNSSRHSASQDGQDTIRGHPGSSRGGRQGSYHEQSVDRSGHSGYHHSHTTPQGRSDASHGQSGPRSASRQTRNEEQSGDGSRHSGSRHHEPSTRAGSSRHSQVGQGESAGSKTSRRQGSSVSQDRDSEGHSEDSERRSESASRNHYGSAREQSRHGSRNPRSHQEDRASHGHSAESSRQSGTRHAETSSGGQAASSQEQARSSPGERHGSRHQQSADSSTDSGTGRRQDSSVVGDSGNRGSSGSQASDSEGHSEESDTQSVSAHGQAGPHQQSHQESTRGQSGERSGRSGSFLYQVSTHEQSESAHGRTGPSTGGRQRSRHEQARDSSRHSASQEGQDTIRGHPGSSRGGRQGSHYEQSVDSSGHSGSHHSHTTSQERSDVSRGQSGSRSVSRQTRNEKQSGDGSRHSGSRHHEASSRADSSRHSQVGQGQSSGPRTSRNQGSSVSQDSDSQGHSEDSERWSGSASRNHLGSAWEQSRDGSRHPGSHHEDRAGHGHSADSSRQSGTRHTESSSRGQAASSHEQARSSAGERHGSHHQLQSADSSRHSGIGHGQASSAVRDSGHRGYSGSQASDSEGHSEDSDTQSVSAQGKAGPHQQSHKESARGQSGESSGRSGSFLYQVSTHEQSESTHGQSAPSTGGRQGSHYDQAQDSSRHSASQEGQDTIRGHPGPSRGGRQGSHQEQSVDRSGHSGSHHSHTTSQGRSDASRGQSGSRSASRKTYDKEQSGDGSRHSGSHHHEASSWADSSRHSLVGQGQSSGPRTSRPRGSSVSQDSDSEGHSEDSERRSGSASRNHHGSAQEQSRDGSRHPRSHHEDRAGHGHSAESSRQSGTHHAENSSGGQAASSHEQARSSAGERHGSHHQQSADSSRHSGIGHGQASSAVRDSGHRGSSGSQASDSEGHSEDSDTQSVSAHGQAGPHQQSHQESTRGRSAGRSGRSGSFLYQVSTHEQSESAHGRTGTSTGGRQGSHHKQARDSSRHSTSQEGQDTIHGHPGSSSGGRQGSHYEQLVDRSGHSGSHHSHTTSQGRSDASHGHSGSRSASRQTRNDEQSGDGSRHSGSRHHEASSRADSSGHSQVGQGQSEGPRTSRNWGSSFSQDSDSQGHSEDSERWSGSASRNHHGSAQEQLRDGSRHPRSHQEDRAGHGHSADSSRQSGTRHTQTSSGGQAASSHEQARSSAGERHGSHHQQSADSSRHSGIGHGQASSAVRDSGHRGYSGSQASDNEGHSEDSDTQSVSAHGQAGSHQQSHQESARGRSGETSGHSGSFLYQVSTHEQSESSHGWTGPSTRGRQGSRHEQAQDSSRHSASQDGQDTIRGHPGSSRGGRQGYHHEHSVDSSGHSGSHHSHTTSQGRSDASRGQSGSRSASRTTRNEEQSGDGSRHSGSRHHEASTHADISRHSQAVQGQSEGSRRSRRQGSSVSQDSDSEGHSEDSERWSGSASRNHHGSAQEQLRDGSRHPRSHQEDRAGHGHSADSSRQSGTRHTQTSSGGQAASSHEQARSSAGERHGSHHQQSADSSRHSGIGHGQASSAVRDSGHRGYSGSQASDNEGHSEDSDTQSVSAHGQAGSHQQSHQESARGRSGETSGHSGSFLYQVSTHEQSESSHGWTGPSTRGRQGSRHEQAQDSSRHSASQYGQDTIRGHPGSSRGGRQGYHHEHSVDSSGHSGSHHSHTTSQGRSDASRGQSGSRSASRTTRNEEQSGDSSRHSVSRHHEASTHADISRHSQAVQGQSEGSRRSRRQGSSVSQDSDSEGHSEDSERWSGSASRNHRGSVQEQSRHGSRHPRSHHEDRAGHGHSADRSRQSGTRHAETSSGGQAASSHEQARSSPGERHGSRHQQSADSSRHSGIPRGQASSAVRDSRHWGSSGSQASDSEGHSEESDTQSVSGHGQAGPHQQSHQESARDRSGGRSGRSGSFLYQVSTHEQSESAHGRTRTSTGRRQGSHHEQARDSSRHSASQEGQDTIRGHPGSSRRGRQGSHYEQSVDRSGHSGSHHSHTTSQGRSDASRGQSGSRSASRQTRNDEQSGDGSRHSWSHHHEASTQADSSRHSQSGQGQSAGPRTSRNQGSSVSQDSDSQGHSEDSERWSGSASRNHRGSAQEQSRDGSRHPTSHHEDRAGHGHSAESSRQSGTHHAENSSGGQAASSHEQARSSAGERHGSHHQQSADSSRHSGIGHGQASSAVRDSGHRGSSGSQASDSEGHSEDSDTQSVSAHGQAGPHQQSHQESTRGRSAGRSGRSGSFLYQVSTHEQSESAHGRAGPSTGGRQGSRHEQARDSSRHSASQEGQDTIRGHPGSRRGGRQGSYHEQSVDRSGHSGSHHSHTTSQGRSDASHGQSGSRSASRETRNEEQSGDGSRHSGSRHHEASTQADSSRHSQSGQGESAGSRRSRRQGSSVSQDSDSEAYPEDSERRSESASRNHHGSSREQSRDGSRHPGSSHRDTASHVQSSPVQSDSSTAKEHGHFSSLSQDSAYHSGIQSRGSPHSSSSYHYQSEGTERQKGQSGLVWRHGSYGSADYDYGESGFRHSQHGSVSYNSNPVVFKERSDICKASAFGKDHPRYYATYINKDPGLCGHSSDISKQLGFSQSQRYYYYE

SEQ ID NO: 153 - protein, 578 aa, Homo sapiens
MRQQDAPKPTPAACRCSGLARRVLTIAFALLILGLMTWAYAAGVPLASDRYGLLAFGLYGAFLSAHLVAQSLFAYLEHRRVAAAARGPLDAATARSVALTISAYQEDPAYLRQCLASARALLYPRARLRVLMVVDGNRAEDLYMVDMFREVFADEDPATYVWDGNYHQPWEPAAAGAVGAGAYREVEAEDPGRLAVEALVRTRRCVCVAQRWGGKREVMYTAFKALGDSVDYVQVCDSDTRLDPMALLELVRVLDEDPRVGAVGGDVRILNPLDSWVSFLSSLRYWVAFNVERACQSYFHCVSCISGPLGLYRNNLLQQFLEAWYNQKFLGTHCTFGDDRHLTNRMLSMGYATKYTSRSRCYSETPSSFLRWLSQQTRWSKSYFREWLYNALWWHRHHAWMTYEAVVSGLFPFFVAATVLRLFYAGRPWALLWVLLCVQGVALAKAAFAAWLRGCLRMVLLSLYAPLYMCGLLPAKFLALVTMNQSGWGTSGRRKLAANYVPLLPLALWALLLLGGLVRSVAHEARADWSGPSRAAEAYHLAAGAGAYVGYWVAMLTLYWVGVRRLCRRRTGGYRVQV

SEQ ID NO: 154 - protein, 577 aa, Homo sapiens
MRQDAPKPTPAACRCSGLARRVLTIAFALLILGLMTWAYAAGVPLASDRYGLLAFGLYGAFLSAHLVAQSLFAYLEHRRVAAAARGPLDAATARSVALTISAYQEDPAYLRQCLASARALLYPRARLRVLMVVDGNRAEDLYMVDMFREVFADEDPATYVWDGNYHQPWEPAAAGAVGAGAYREVEAEDPGRLAVEALVRTRRCVCVAQRWGGKREVMYTAFKALGDSVDYVQVCDSDTRLDPMALLELVRVLDEDPRVGAVGGDVRILNPLDSWVSFLSSLRYWVAFNVERACQSYFHCVSCISGPLGLYRNNLLQQFLEAWYNQKFLGTHCTFGDDRHLTNRMLSMGYATKYTSRSRCYSETPSSFLRWLSQQTRWSKSYFREWLYNALWWHRHHAWMTYEAVVSGLFPFFVAATVLRLFYAGRPWALLWVLLCVQGVALAKAAFAAWLRGCLRMVLLSLYAPLYMCGLLPAKFLALVTMNQSGWGTSGRRKLAANYVPLLPLALWALLLLGGLVRSVAHEARADWSGPSRAAEAYHLAAGAGAYVGYWVAMLTLYWVGVRRLCRRRTGGYRVQV

SEQ ID NO: 155 - protein, 552 aa, Homo sapiens
MHCERFLCILRIIGTTLFGVSLLLGITAAYIVGYQFIQTDNYYFSFGLYGAFLASHLIIQSLFAFLEHRKMKKSLETPIKLNKTVALCIAAYQEDPDYLRKCLQSVKRLTYPGIKVVMVIDGNSEDDLYMMDIFSEVMGRDKSATYIWKNNFHEKGPGETDESHKESSQHVTQLVLSNKSICIMQKWGGKREVMYTAFRALGRSVDYVQVCDSDTMLDPASSVEMVKVLEEDPMVGGVGGDVQILNKYDSWISFLSSVRYWMAFNIERACQSYFGCVQCISGPLGMYRNSLLHEFVEDWYNQEFMGNQCSFGDDRHLTNRVLSLGYATKYTARSKCLTETPIEYLRWLNQQTRWSKSYFREWLYNAMWFHKHHLWMTYEAIITGFFPFFLIATVIQLFYRGKIWNILLFLLTVQLVGLIKSSFASCLRGNIVMVFMSLYSVLYMSSLLPAKMFAIATINKAGWGTSGRKTIVVNFIGLIPVSVWFTILLGGVIFTIYKESKRPFSESKQTVLIVGTLLYACYWVMLLTLYVVLINKCGRRKKGQQYDMVLDV

SEQ ID NO: 156 - protein, 553 aa, Homo sapiens
MPVQLTTALRVVGTSLFALAVLGGILAAYVTGYQFIHTEKHYLSFGLYGAILGLHLLIQSLFAFLEHRRMRRAGQALKLPSPRRGSVALCIAAYQEDPDYLRKCLRSAQRISFPDLKVVMVVDGNRQEDAYMLDIFHEVLGGTEQAGFFVWRSNFHEAGEGETEASLQEGMDRVRDVVRASTFSCIMQKWGGKREVMYTAFKALGDSVDYIQVCDSDTVLDPACTIEMLRVLEEDPQVGGVGGDVQILNKYDSWISFLSSVRYWMAFNVERACQSYFGCVQCISGPLGMYRNSLLQQFLEDWYHQKFLGSKCSFGDDRHLTNRVLSLGYRTKYTARSKCLTETPTKYLRWLNQQTRWSKSYFREWLYNSLWFHKHHLWMTYESVVTGFFPFFLIATVIQLFYRGRIWNILLFLLTVQLVGIIKATYACFLRGNAEMIFMSLYSLLYMSSLLPAKIFAIATINKSGWGTSGRKTIVVNFIGLIPVSIWVAVLLGGLAYTAYCQDLFSETELAFLVSGAILYGCYWVALLMLYLAIIARRCGKKPEQYSLAFAEV

SEQ ID NO: 157 - protein, 281 aa, Homo sapiens
MPVQLTTALRVVGTSLFALAVLGGILAAYVTGYQFIHTEKHYLSFGLYGAILGLHLLIQSLFAFLEHRRMRRAGQALKLPSPRRGSVALCIAAYQEDPDYLRKCLRSAQRISFPDLKVVMVVDGNRQEDAYMLDIFHEVLGGTEQAGFFVWRSNFHEAGEGETEASLQEGMDRVRDVVRASTFSCIMQKWGGKREVMYTAFKALGDSVDYIQVCDSDTVLDPACTIEMLRVLEEDPQVGGVGGDVQPPGKGMAVEDDQVQAAQVRATEAWSVHQRHVSREQ

SEQ ID NO: 158 - protein, 267 aa, Homo sapiens
MPRSCCSRSGALLLALLLQASMEVRGWCLESSQCQDLTTESNLLECIRACKPDLSAETPMFPGNGDEQPLTENPRKYVMGHFRWDRFGRRNSSSSGSSGAGQKREDVSAGEDCGPLPEGGPEPRSDGAKPGPREGKRSYSMEHFRWGKPVGKKRRPVKVYPNGAEDESAEAFPLEFKRELTGQRLREGDGPDGPADDGAGAQADLEHSLLVAAEKKDEGPYRMEHFRWGSPPKDKRYGGFMTSEKSQTPLVTLFKNAIIKNAYKKGE

SEQ ID NO: 159 - protein, 726 aa, Homo sapiens
MNHSPLKTALAYECFQDQDNSTLALPSDQKMKTGTSGRQRVQEQVMMTVKRQKSKSSQSSTLSHSNRGSMYDGLADNYNYGTTSRSSYYSKFQAGNGSWGYPIYNGTLKREPDNRRFSSYSQMENWSRHYPRGSCNTTGAGSDICFMQKIKASRSEPDLYCDPRGTLRKGTLGSKGQKTTQNRYSFYSTCSGQKAIKKCPVRPPSCASKQDPVYIPPISCNKDLSFGHSRASSKICSEDIECSGLTIPKAVQYLSSQDEKYQAIGAYYIQHTCFQDESAKQQVYQLGGICKLVDLLRSPNQNVQQAAAGALRNLVFRSTTNKLETRRQNGIREAVSLLRRTGNAEIQKQLTGLLWNLSSTDELKEELIADALPVLADRVIIPFSGWCDGNSNMSREVVDPEVFFNATGCLRNLSSADAGRQTMRNYSGLIDSLMAYVQNCVAASRCDDKSVENCMCVLHNLSYRLDAEVPTRYRQLEYNARNAYTEKSSTGCFSNKSDKMMNNNYDCPLPEEETNPKGSGWLYHSDAIRTYLNLMGKSKKDATLEACAGALQNLTASKGLMSSGMSQLIGLKEKGLPQIARLLQSGNSDVVRSGASLLSNMSRHPLLHRVMGNQVFPEVTRLLTSHTGNTSNSEDILSSACYTVRNLMASQPQLAKQYFSSSMLNNIINLCRSSASPKAAEAARLLLSDMWSSKELQGVLRQQGFDRNMLGTLAGANSLRNFTSRF

SEQ ID NO: 160 - protein, 747 aa, Homo sapiens
MNHSPLKTALAYECFQDQDNSTLALPSDQKMKTGTSGRQRVQEQVMMTVKRQKSKSSQSSTLSHSNRGSMYDGLADNYNYGTTSRSSYYSKFQAGNGSWGYPIYNGTLKREPDNRRFSSYSQMENWSRHYPRGSCNTTGAGSDICFMQKIKASRSEPDLYCDPRGTLRKGTLGSKGQKTTQNRYSFYSTCSGQKAIKKCPVRPPSCASKQDPVYIPPISCNKDLSFGHSRASSKICSEDIECSGLTIPKAVQYLSSQDEKYQAIGAYYIQHTCFQDESAKQQVYQLGGICKLVDLLRSPNQNVQQAAAGALRNLVFRSTTNKLETRRQNGIREAVSLLRRTGNAEIQKQLTGLLWNLSSTDELKEELIADALPVLADRVIIPFSGWCDGNSNMSREVVDPEVFFNATGCLRKRLGMRELLALVPQRATSSRVNLSSADAGRQTMRNYSGLIDSLMAYVQNCVAASRCDDKSVENCMCVLHNLSYRLDAEVPTRYRQLEYNARNAYTEKSSTGCFSNKSDKMMNNNYDCPLPEEETNPKGSGWLYHSDAIRTYLNLMGKSKKDATLEACAGALQNLTASKGLMSSGMSQLIGLKEKGLPQIARLLQSGNSDVVRSGASLLSNMSRHPLLHRVMGNQVFPEVTRLLTSHTGNTSNSEDILSSACYTVRNLMASQPQLAKQYFSSSMLNNIINLCRSSASPKAAEAARLLLSDMWSSKELQGVLRQQGFDRNMLGTLAGANSLRNFTSRF

SEQ ID NO: 161 - protein, 341 aa, Homo sapiens
MNIVVEFFVVTFKVLWAFVLAAARWLVRPKEKSVAGQVCLITGAGSGLGRLFALEFARRRALLVLWDINTQSNEETAGMVRHIYRDLEAADAAALQAGNGEEEILPHCNLQVFTYTCDVGKRENVYLTAERVRKEVGEVSVLVNNAGVVSGHHLLECPDELIERTMMVNCHAHFWTTKAFLPTMLEINHGHIVTVASSLGLFSTAGVEDYCASKFGVVGFHESLSHELKAAEKDGIKTTLVCPYLVDTGMFRGCRIRKEIEPFLPPLKPDYCVKQAMKAILTDQPMICTPRLMYIVTFMKSILPFEAVVCMYRFLGADKCMYPFIAQRKQATNNNEAKNGI

SEQ ID NO: 162 - protein, 307 aa, Homo sapiens
MGGLTASDVHPTLGVQLFSAGIAACLADVITFPLDTAKVRLQVQGECPTSSVIRYKGVLGTITAVVKTEGRMKLYSGLPAGLQRQISSASLRIGLYDTVQEFLTAGKETAPSLGSKILAGLTTGGVAVFIGQPTEVVKVRLQAQSHLHGIKPRYTGTYNAYRIIATTEGLTGLWKGTTPNLMRSVIINCTELVTYDLMKEAFVKNNILADDVPCHLVSALIAGFCATAMSSPVDVVKTRFINSPPGQYKSVPNCAMKVFTNEGPTAFFKGLVPSFLRLGSWNVIMFVCFEQLKRELSKSRQTMDCAT

SEQ ID NO: 163 - protein, 529 aa, Homo sapiens [sequence omitted]

SEQ ID NO: 164 - protein, 7 aa, Artificial Sequence
  Synthetic sequence
PKKKRKV

SEQ ID NO: 165 - protein, 16 aa, Artificial Sequence
  Synthetic sequence
LGRVIPRKIASRASLM

SEQ ID NO: 166 - DNA, 32 bp, Artificial Sequence
  Synthetic sequence
aaaaaaaccggttcattttctcttccggccac

SEQ ID NO: 167 - DNA, 27 bp, Artificial Sequence
  Synthetic sequence
aaaaaagctagcatggcgggtctgacg

SEQ ID NO: 168 - DNA, 32 bp, Artificial Sequence; identical to SEQ ID NO: 166
  Synthetic sequence

What is claimed is:

1. An in vivo method for treating dystrophic epidermolysis bullosa, comprising delivering a synthetic RNA encoding a gene-editing protein that targets a COL7 gene to a patient in need thereof and delivering a COL7 repair template to the patient, thereby editing the COL7 gene, wherein:

the synthetic RNA and repair template are delivered to the patient's keratinocytes by injection to the epidermis and the gene-editing protein comprises a DNA-binding domain and a nuclease domain and causes a double-strand break in the COL7 gene of the patient's keratinocytes.

2. The method of claim 1, wherein the gene-editing protein corrects or eliminates, either alone or in combination with one or more other molecules or gene-editing proteins, a mutation that is at least partially responsible for a disease phenotype.

3. The method of claim 1, wherein the COL7 repair template is a single-stranded DNA molecule or a double-stranded DNA molecule.

4. The method of claim 1, wherein the COL7 repair template does not contain a binding site of the gene-editing protein.

5. The method of claim 1, wherein the gene-editing protein targets a nucleic acid sequence that encodes the amino acid sequence of SEQ ID NO: 78.

6. The method of claim 1, wherein the gene-editing protein is selected from the group consisting of a nuclease, a transcription activator-like effector nuclease (TALEN), a zinc-finger nuclease, a meganuclease, a nickase, and a clustered regularly interspaced short palindromic repeat (CRISPR)-associated protein.

7. The method of claim 1, wherein the synthetic RNA molecule further comprises one or more of a 5'-cap, a 5'-cap 1 structure, and a 3'-poly(A) tail.

* * * * *